United States Patent 12,371,699 (NUCLEIC ACIDS ENCODING CRISPR-ASSOCIATED PROTEINS AND USES THEREOF) - sequence listing, part 3

SEQ ID NO: 2161 - RNA, 4263 nt, synthetic construct
  misc_feature 1..4263: note = Cas9 variant
  source 1..4263: mol_type = other RNA
atggccaagttcaacaagaactacagcatcggcctggacatcggggtgtccagcgtcggctacgccgtggtgaccgacgactaccgcgtccccgcgttcaagttcaaggtgctcgggaacaccgagaaggagaagatcaagaagaacctgatcggctccacgaccttcgtgccggcccagagcgcccaggggacccgggtcttccgcgtgaaccggcgccggatcgaccgccggaaccaccgcatcgcctacctgcgggacatcttccagaaggagatcgagaaggtggacaagaacttctaccgccggctcgacgagtccttccgcgtcctgggcgacaagagcgaggagctgcagatcaagcagcccttcttcggcgacaaggagctcgagaccgcctaccacaagaagtaccccacgatctaccacctccggaagcacctggcggacgccgacaagaactcccccgtggccgacatccgcgaggtgtacatggccatcagccacatcctgaagtaccgggggcacttcctgaccctggaccgcatcaacccgaacaacatcaacatgcagaactcctggatcgacttcatcgagagctgccaggaggtcttcgacctcgagatctccgacgagagcaagaccatcgtggcgatcttcaagtccagcgacaaccggcaggagaaggtgaagaagatcctgtcctacttccagcaggagctgctcaagaaggacaagagcatcttcaagcagctgctgcagctcctgttcggcctgaagaccaagttcaaggactgcttcgagctcgaggaggagcccgacctgaacttctccaaggagaactacgacgagaacctggagaacttcctcgggagcctggaggaggacttctccgacgtcttcgccaagctgaaggtgctccgcgacacgatcctgctgagcggcatgctcacctacaccgggaccacgcgggcccgcttcagcgccaccatggtggagcggtacgaggagcaccgcaaggacctgcagcgcttcaagtccttcgtcaagcagaacctgagcgagcaggactacctcgacatcttcggccggaagacccccaacggcttcgacgtggacaaggagaccaaggggtacgtgggctacatctccaacaagatggtcctgacgaacccccagaagcagaagaccatccagcagaacttctacgactacatcagcgggaagatcaccggcatcgagggcgccgagtacttcctgaacaagatctccgacgggaccttcctccgcaagctgcggacgaccgacaacggcgcggtgccgaaccagatccacgcctacgagctggagaagatcatcgaccgccagggggaggactaccccttcctcctggagaacaaggacaagctgctcagcatcctgaccttcaagatcccctactacgtgggccccctgtccaaggggaacaacagccggttcggctggatcaagcgcaccatctcccaggacatcctcgacgacaacgacgaggacacgcggaacggcaagatccgcccgtggaactaccagaagctgatcaacatggacgagacccgggacgccttcatcaccaacctgatcgggaacgacatcatcctcctgaacgagaaggtcctgcccaagcgcagcctgatctacgaggaggtgatgctccagaacgagctgacccgggtcaagtacaaggacaagtacggcaagacgcacttcttcgactccgagctgcgccaggagatcatcaacaacctcttcaagaccaacaacaagcgggtgagctccgccatgctgctggactacctcgagaactacaccaacctgcaggccgtggagatcgtcagcgggatcgagaagggcaagtccctgaacagcaccctcaagacgtacaacgacctgaagaccatcttctccgaggagctgctcgacagcgagatctaccagaaggagctggaggagatcgtgaaggtgatcaccgtcttcgacgacaagaagtccatcaagaactacctgatcaagtacttcgggcacctcgagttcctgaacgaggagcgcatcaaccagctgagcaagctccggtacaccggctggggccgctacagcgcgaagctgctgctcgacatccgggacgaggacacggggttcaacctgatgcagttcctgcgcaacgacgacgagaaccggaacctctcccagctgatcagcgactccaccctgagcttcgactccgccatcaagagcatccagtccaagagcaccgtggaggacgacgtgttcgacgagatcaagaagctcgccggctcccccgccatcaagcgcgggatcctgaacagcatcaagatcgtcgacgagctggtgcagatcatcggctacccgccccagaacatcgtgatcgagatggcccgcgagaacatgaccaccgaggaggggcagaagaaggcgaagacgcggaagaccaagctcgagtccgccctgaagaacatcgagaacagcgtcctggagaacggcaaggtgccccactccgacgagcagctccagagcgagaagctgtacctgtactacctccagaacggcaaggacatgtactccctggacaagaccgggagccccacgcccctgtaccgcgaccagctcgaccagtacgaggtggaccacatcatcccgtactccttcctgcccatcgacagcatcgacaacaaggtcctgacccaccgggagaacaaccagcgcaagctcaacaacatccccgacaaggagaccgtggccaacatgaagcccttctgggagaagctgtacaacgccaagctgatcagccagaccaagtaccagcggctcaccacgtccgagcgcaccccggacggcgtgctgaccgagagcatgaaggccgggttcatcgagcggcagctggtcgagacccgccagatcatcaagcacgtggcgcggatcctcgacaaccgcttcctggacacgaagatcatcgccctgaagtcccagctcatcaccaacttccggaacaccttccacatcgccaagatccgcgagctgaacgactaccaccacgcccacgacgcgtacctggccgtggtcgtgggccagaccctcctgaaggcctaccccaagctggcccccgagctcatctacggccaccacgcccacttcaaccggcacgaggagaacaaggcgacgatccgcaagcacctgtacagcaacatcatgcggttcttcaacaaccccgactccaaggtgagcaaggacatctgggactgcaaccgcgacctgccgatcatcaaggaggtcatctacaactcccaggtgaacttcgtgaagcggaccatgatcaagaagggggccttctacaaccagaaccccgtcggcaagttcaacaagcagatcgccgccaacaaccgctaccccctcaagaccaaggtgagctccctggacaccagcatctacgggggctacgggccgatgaactccgccctgagcatcatcatcatcgcggagcggttcaacgagaagaagggcaagatcgagacggtgaaggagttccacgacatcttcatcatcgactacaagaagttcaacaacaaccccttccagttcctcaacgacacctccgagaacggcttcctgaagaagaacaacatcaaccgcgtcctggccttctacggggtgcccaagtacagcctcatgcagaagaacgacggcacccggatgctgttcgagtccaagagcaacctgcacaaggccacccagttcaagctcacgaagacccagaacgagctgttcttccacatgcgccgcctgctcaccaagtccaacctgatggacctcaagagcgagtccgccatcaaggagagccagaacttcatcctgaagcacaaggaggagttcgacaacatcagcaaccagctgtccgccttcagccagaagatgctgggggacaccacgtccctccggaacctgatcaagggctacaacgagcgcaagatcaaggagatcgacagctccgaggaggtgatcaagtacttctacgacaacttcatcaagatgttcagcttcgtcaagtccggggcgcccaagggcatcaacgacttcttcaacaacaagtacaccgtggcccggatgcgcccgaagcccgacaagaagttcctgaacgccaccctcatccaccagagcatcaccggcctgtacgagacgcggatcgacctgtccaagctcggggaggactga

SEQ ID NO: 2162 - RNA, 4263 nt, synthetic construct
  misc_feature 1..4263: note = Cas9 variant
  source 1..4263: mol_type = other RNA
atggccaagttcaacaagaactacagcatcggcctggacatcggggtgtccagcgtcggctacgccgtggtgaccgacgactaccgcgtccccgcgttcaagttcaaggtgctcgggaacaccgagaaggagaagatcaagaagaacctgatcggctccacgaccttcgtgccggcccagagcgcccaggggacccgggtcttccgcgtgaaccggcgccggatcgaccgccggaaccaccgcatcgcctacctgcgggacatcttccagaaggagatcgagaaggtggacaagaacttctaccgccggctcgacgagtccttccgcgtcctgggcgacaagagcgaggagctgcagatcaagcagcccttcttcggcgacaaggagctcgagaccgcctaccacaagaagtaccccacgatctaccacctccggaagcacctggcggacgccgacaagaactcccccgtggccgacatccgcgaggtgtacatggccatcagccacatcctgaagtaccgggggcacttcctgaccctggaccgcatcaacccgaacaacatcaacatgcagaactcctggatcgacttcatcgagagctgccaggaggtcttcgacctcgagatctccgacgagagcaagaccatcgtggcgatcttcaagtccagcgacaaccggcaggagaaggtgaagaagatcctgtcctacttccagcaggagctgctcaagaaggacaagagcatcttcaagcagctgctgcagctcctgttcggcctgaagaccaagttcaaggactgcttcgagctcgaggaggagcccgacctgaacttctccaaggagaactacgacgagaacctggagaacttcctcgggagcctggaggaggacttctccgacgtcttcgccaagctgaaggtgctccgcgacacgatcctgctgagcggcatgctcacctacaccgggaccacgcgggcccgcttcagcgccaccatggtggagcggtacgaggagcaccgcaaggacctgcagcgcttcaagtccttcgtcaagcagaacctgagcgagcaggactacctcgacatcttcggccggaagacccccaacggcttcgacgtggacaaggagaccaaggggtacgtgggctacatctccaacaagatggtcctgacgaacccccagaagcagaagaccatccagcagaacttctacgactacatcagcgggaagatcaccggcatcgagggcgccgagtacttcctgaacaagatctccgacgggaccttcctccgcaagctgcggacgaccgacaacggcgcggtgccgaaccagatccacgcctacgagctggagaagatcatcgaccgccagggggaggactaccccttcctcctggagaacaaggacaagctgctcagcatcctgaccttcaagatcccctactacgtgggccccctgtccaaggggaacaacagccggttcggctggatcaagcgcaccatctcccaggacatcctcgacgacaacgacgaggacacgcggaacggcaagatccgcccgtggaactaccagaagctgatcaacatggacgagacccgggacgccttcatcaccaacctgatcgggaacgacatcatcctcctgaacgagaaggtcctgcccaagcgcagcctgatctacgaggaggtgatgctccagaacgagctgacccgggtcaagtacaaggacaagtacggcaagacgcacttcttcgactccgagctgcgccaggagatcatcaacaacctcttcaagaccaacaacaagcgggtgagctccgccatgctgctggactacctcgagaactacaccaacctgcaggccgtggagatcgtcagcgggatcgagaagggcaagtccctgaacagcaccctcaagacgtacaacgacctgaagaccatcttctccgaggagctgctcgacagcgagatctaccagaaggagctggaggagatcgtgaaggtgatcaccgtcttcgacgacaagaagtccatcaagaactacctgatcaagtacttcgggcacctcgagttcctgaacgaggagcgcatcaaccagctgagcaagctccggtacaccggctggggccgctacagcgcgaagctgctgctcgacatccgggacgaggacacggggttcaacctgatgcagttcctgcgcaacgacgacgagaaccggaacctctcccagctgatcagcgactccaccctgagcttcgactccgccatcaagaccatccagagcaagtccaccgtggaggacgacgtgttcgacgagatcaagaagctcgccggcagccccgccatcaagcgcgggatcctgaactccatcaagatcgtcgacgagctggtgcagatcatcggctacccgccccagaacatcgtgatcgagatggcccgcgagaacatgaccacggaggaggggcagaagaaggcgaagacccggaagaccaagctcgagagcgccctgaagaacatcgagaactccgtcctggagaacggcaaggtgccccacagcgacgagcagctccagtccgagaagctgtacctgtactacctccagaacggcaaggacatgtacagcctggacaagaccgggtcccccacgcccctgtaccgcgaccagctcgaccagtacgaggtggaccacatcatcccgtacagcttcctgcccatcgactccatcgacaacaaggtcctgacccaccgggagaacaaccagcgcaagctcaacaacatccccgacaaggagaccgtggccaacatgaagcccttctgggagaagctgtacaacgccaagctgatcagccagaccaagtaccagcggctcacgaccagcgagcgcaccccggacggcgtgctgaccgagtccatgaaggccgggttcatcgagcggcagctggtcgagacgcgccagatcatcaagcacgtggcgcggatcctcgacaaccgcttcctggacaccaagatcatcgccctcaagagccagctgatcaccaacttccggaacaccttccacatcgccaagatccgcgagctgaacgactaccaccacgcccacgacgcgtacctggccgtggtcgtgggccagacgctcctgaaggcctaccccaagctggcccccgagctcatctacggccaccacgcccacttcaaccggcacgaggagaacaaggcgaccatccgcaagcacctgtactccaacatcatgcggttcttcaacaaccccgacagcaaggtgtccaaggacatctgggactgcaaccgcgacctgccgatcatcaaggaggtcatctacaacagccaggtgaacttcgtgaagcggaccatgatcaagaagggggccttctacaaccagaaccccgtcggcaagttcaacaagcagatcgccgccaacaaccgctaccccctcaagaccaaggtgtccagcctggacacgtccatctacgggggctacgggccgatgaacagcgccctgtccatcatcatcatcgcggagcggttcaacgagaagaagggcaagatcgagaccgtgaaggagttccacgacatcttcatcatcgactacaagaagttcaacaacaaccccttccagttcctcaacgacaccagcgagaacggcttcctgaagaagaacaacatcaaccgcgtcctggccttctacggggtgcccaagtactccctcatgcagaagaacgacggcacccggatgctgttcgagagcaagtccaacctgcacaaggccacgcagttcaagctcaccaagacccagaacgagctgttcttccacatgcgccgcctgctcaccaagagcaacctgatggacctgaagtccgagagcgccatcaaggagtcccagaacttcatcctcaagcacaaggaggagttcgacaacatcagcaaccagctgagcgccttctcccagaagatgctgggggacacgaccagcctccggaacctgatcaagggctacaacgagcgcaagatcaaggagatcgactccagcgaggaggtgatcaagtacttctacgacaacttcatcaagatgttctccttcgtcaagagcggggcgcccaaggacatcaacgacttcttcaacaacaagtacaccgtggcccggatgcgcccgaagcccgacaagaagttcctgaacgccaccctcatccaccagtccatcacgggcctgtacgagacccggatcgacctgagcaagctcggcgaggactga

SEQ ID NO: 2163 - RNA, 4263 nt, synthetic construct
  misc_feature 1..4263: note = Cas9 variant
  source 1..4263: mol_type = other RNA
atggccaagttcaacaagaactacagcatcggcctggacatcggggtgtccagcgtcggctacgccgtggtgaccgacgactaccgcgtccccgcgttcaagttcaaggtgctcgggaacaccgagaaggagaagatcaagaagaacctgatcggctccacgaccttcgtgccggcccagagcgcccaggggacccgggtcttccgcgtgaaccggcgccggatcgaccgccggaaccaccgcatcgcctacctgcgggacatcttccagaaggagatcgagaaggtggacaagaacttctaccgccggctcgacgagtccttccgcgtcctgggcgacaagagcgaggagctgcagatcaagcagcccttcttcggcgacaaggagctcgagaccgcctaccacaagaagtaccccacgatctaccacctccggaagcacctggcggacgccgacaagaactcccccgtggccgacatccgcgaggtgtacatggccatcagccacatcctgaagtaccgggggcacttcctgaccctggaccgcatcaacccgaacaacatcaacatgcagaactcctggatcgacttcatcgagagctgccaggaggtcttcgacctcgagatctccgacgagagcaagaccatcgtggcgatcttcaagtccagcgacaaccggcaggagaaggtgaagaagatcctgtcctacttccagcaggagctgctcaagaaggacaagagcatcttcaagcagctgctgcagctcctgttcggcctgaagaccaagttcaaggactgcttcgagctcgaggaggagcccgacctgaacttctccaaggagaactacgacgagaacctggagaacttcctcgggagcctggaggaggacttctccgacgtcttcgccaagctgaaggtgctccgcgacacgatcctgctgagcggcatgctcacctacaccgggaccacgcgggcccgcttcagcgccaccatggtggagcggtacgaggagcaccgcaaggacctgcagcgcttcaagtccttcgtcaagcagaacctgagcgagcaggactacctcgacatcttcggccggaagacccccaacggcttcgacgtggacaaggagaccaaggggtacgtgggctacatctccaacaagatggtcctgacgaacccccagaagcagaagaccatccagcagaacttctacgactacatcagcgggaagatcaccggcatcgagggcgccgagtacttcctgaacaagatctccgacgggaccttcctccgcaagctgcggacgaccgacaacggcgcggtgccgaaccagatccacgcctacgagctggagaagatcatcgaccgccagggggaggactaccccttcctcctggagaacaaggacaagctgctcagcatcctgaccttcaagatcccctactacgtgggccccctgtccaaggggaacaacagccggttcggctggatcaagcgcaccatctcccaggacatcctcgacgacaacgacgaggacacgcggaacggcaagatccgcccgtggaactaccagaagctgatcaacatggacgagacccgggacgccttcatcaccaacctgatcgggaacgacatcatcctcctgaacgagaaggtcctgcccaagcgcagcctgatctacgaggaggtgatgctccagaacgagctgacccgggtcaagtacaaggacaagtacggcaagacgcacttcttcgactccgagctgcgccaggagatcatcaacaacctcttcaagaccaacaacaagcgggtgagctccgccatgctgctggactacctcgagaactacaccaacctgcaggccgtggagatcgtcagcgggatcgagaagggcaagtccctgaacagcaccctcaagacgtacaacgacctgaagaccatcttctccgaggagctgctcgacagcgagatctaccagaaggagctggaggagatcgtgaaggtgatcaccgtcttcgacgacaagaagtccatcaagaactacctgatcaagtacttcgggcacctcgagttcctgaacgaggagcgcatcaaccagctgagcaagctccggtacaccggctggggccgctacagcgcgaagctgctgctcgacatccgggacgaggacacggggttcaacctgatgcagttcctgcgcaacgacgacgagaaccggaacctctcccagctgatcagcgactccaccctgagcttcgactccgccatcaagagcatccagtccaagagcaccgtggaggacgacgtgttcgacgagatcaagaagctcgccggctcccccgccatcaagcgcgggatcctgaacagcatcaagatcgtcgacgagctggtgcagatcatcggctacccgccccagaacatcgtgatcgagatggcccgcgagaacatgaccaccgaggaggggcagaagaaggcgaagacgcggaagaccaagctcgagtccgccctgaagaacatcgagaacagcgtcctggagaacggcaaggtgccccactccgacgagcagctccagagcgagaagctgtacctgtactacctccagaacggcaaggacatgtactccctggacaagaccgggagccccacgcccctgtaccgcgaccagctcgaccagtacgaggtggaccacatcatcccgtactccttcctgcccatcgacagcatcgacaacaaggtcctgacccaccgggagaacaaccagcgcaagctcaacaacatccccgacaaggagaccgtggccaacatgaagcccttctgggagaagctgtacaacgccaagctgatcagccagaccaagtaccagcggctcaccacgtccgagcgcaccccggacggcgtgctgaccgagagcatgaaggccgggttcatcgagcggcagctggtcgagacccgccagatcatcaagcacgtggcgcggatcctcgacaaccgcttcctggacacgaagatcatcgccctgaagtcccagctcatcaccaacttccggaacaccttccacatcgccaagatccgcgagctgaacgactaccaccacgcccacgacgcgtacctggccgtggtcgtgggccagaccctcctgaaggcctaccccaagctggcccccgagctcatctacggccaccacgcccacttcaaccggcacgaggagaacaaggcgacgatccgcaagcacctgtacagcaacatcatgcggttcttcaacaaccccgactccaaggtgagcaaggacatctgggactgcaaccgcgacctgccgatcatcaaggaggtcatctacaactcccaggtgaacttcgtgaagcggaccatgatcaagaagggggccttctacaaccagaaccccgtcggcaagttcaacaagcagatcgccgccaacaaccgctaccccctcaagaccaaggtgagctccctggacaccagcatctacgggggctacgggccgatgaactccgccctgagcatcatcatcatcgcggagcggttcaacgagaagaagggcaagatcgagacggtgaaggagttccacgacatcttcatcatcgactacaagaagttcaacaacaaccccttccagttcctcaacgacacctccgagaacggcttcctgaagaagaacaacatcaaccgcgtcctggccttctacggggtgcccaagtacagcctcatgcagaagaacgacggcacccggatgctgttcgagtccaagagcaacctgcacaaggccacccagttcaagctcacgaagacccagaacgagctgttcttccacatgcgccgcctgctcaccaagtccaacctgatggacctcaagagcgagtccgccatcaaggagagccagaacttcatcctgaagcacaaggaggagttcgacaacatcagcaaccagctgtccgccttcagccagaagatgctgggggacaccacgtccctccggaacctgatcaagggctacaacgagcgcaagatcaaggagatcgacagctccgaggaggtgatcaagtacttctacgacaacttcatcaagatgttcagcttcgtcaagtccggggcgcccaaggacatcaacgacttcttcaacaacaagtacaccgtggcccggatgcgcccgaagcccgacaagaagttcctgaacgccaccctcatccaccagagcatcaccggcctgtacgagacgcggatcgacctgtccaagctcggcgaggactga

SEQ ID NO: 2164 - RNA, 4263 nt, synthetic construct
  misc_feature 1..4263: note = Cas9 variant
  source 1..4263: mol_type = other RNA
atggccaagttcaacaagaactacagcatcggcctggacatcggggtgtccagcgtcggctacgccgtggtgaccgaggactaccgcgtccccgcgttcaagttcaaggtgctcgggaacaccgagaaggagaagatcaagaagaacctgatcggctccacgaccttcgtgccggcccagagcgcccaggggacccgggtcttccgcgtgaaccggcgccggatcgaccgccggaaccaccgcatcgcctacctgcgggacatcttccagaaggagatcgagaagatcgacaagaacttctaccgccggctcgacgagtccttccgcgtgctgggcgacaagagcgaggacatccagatcaagcagcccttcttcggcaacaaggagctggagaccgcctaccacaagaagtaccccacgatctaccacctccggaagcacctggcggacgccgacaagaactcccccgtcgccgacatccgcgaggtgtacatggtgctgagccacatcctcaagtaccgggggcacttcctgaccctgggcaagatcgacccgaacaacatcaacatgcagaactcctggatcgacttcatcgagagctgccaggacgccttcgacctcgagatctccgacgagagcaagaccatcgcggccatcttcaagtccagcgagaaccgccaggagaaggtcaagcagatcctgtcctacttccagcaggagctgctcaagaaggacaagagcatcttcaagcagctgctgcagctcctgttcgggctgaagaccaagttcaaggactgcttcgagctcgaggaggagcccgacctgaacttctccaaggagaactacgacgagaacctggagaacctcctgggcgccctggaggaggacttcagcgacgtgttcgccaagctcaagatcctgcgggacacgatcctgctctccagcatgctgacctacaccggggccacccacgcgcgcttcagcgccacgatggtggagcggtacgaggagcaccgcaaggacctgcagcggttcaagtccttcgtcaagcagaacctcagcgagcaggactacctggacatcttcggccgcaagacccccaccggcttcgacgtggacaaggagaccaaggggtacgtgggctacatctccaacaagatggtcctgacgaacccccagaagcagaagaccatccagcagaacttctacgactacatcagcgggaagatcaccggcatcgagggcgccgagtgcttcctcaacaagatctccgacgggaccttcctgcgcaagctgcggacgaccgacaacggcgccatcccgaaccagatccacgcctacgagctcgagaagatcatcgagcgccaggggcgggactaccccttcctgctggagaacaaggacaagctcctgagcatcctgaccttcaagatcccctactacgtgggccccctcgcgaaggggaacaactcccgcttcgcctggatcaagcggaccacgagccaggacgtgctggacgacaacgacgaggacacccgcaacggcaagatccggccgtggaactaccacaagctgatcaacatggacgagacccgcgacgccttcatcatcaacctcatcggcaacgacatcatcctgctgaacgagaaggtcctgcccaagcggtccctcatctacgaggaggtgatgctgcagaacgagctgacccgcgtgaagtacaaggacaagtacgggaagatccacttcttcaacagcgagctccggcaggagatcatcaacaacctgttcaagacgaactccaagcgcgtcagctccgccatgctgctcagctacctggagaacttcaccaacctgcaggccgtggagatcgtctccggcatcgagaagggcaagagcctcaactccaccctgaagacctacaacgacctgaagacgatcttcagcgaggagctcctggactccgagatctaccagaaggagctggaggagatcatcaaggtgatcaccgtgttcgacgacaagaagtccatcaagaactacctcaccaagtacttcgggcacctggagttcctgaacgaggagaagatcaaccagctcagcaagctgcggtacaccgggtggggccgctacagcggcaagctgctcctggggatccgggacgaggacacgggcttcaacctgatgcagttcctccgcaacgacgacgagaaccggaacctgacccagctgatcagcgacaccaccctctccttcgacagcgcgatcaaggccatccagtccaagagcaccgtcgaggacgacgtgttcgaggagatcaagaacctggccgggtcccccgccatcaagcgcggcatcctgaacagcatcaagatcgtggacgagctcgtccagatcatcgggtacccgccccagaacatcatcatcgagatggcccgggagaacatgacgaccgaggagggccagaagaaggcgaagacccgcaagtccaagctggagagcgccctgaagaacatcgaggactccgtgctcgagagcggcaaggtgccccactccgacgagcagctgcagagcgagaagctgtacctctactacctgcagaacgggaaggacatgtactccctggacaagaccggcagccccacgcccctctaccgcgaccagctggaccagtacgaggtcgaccacatcatcccgtactccttcctgcccatcgacagcatcgacaacaaggtgctcacccaccgggagaacaaccagcgcaagctgaacaacatccccgacaaggagaccgtggccaacatgaagcccttctgggagaagctgtacaacgccaagctcatcagccagaccaagtaccagcggctgacgacctccgagcgcaccccggacggggtcctgaccgagagcatgaaggcgggcttcatcgagcggcagctcgtggagacgcgccagatcatcaagcacgtggcccggatcctggacaaccgcttctccgacaccaagatcatcaccctcaagagccagctggtcaccaacttccggaacacgttccacatcgccaagatccgcgagctgaacgactaccaccacgcccacgacgcctacctggcggtggtggtcggccagaccctcctgaaggcctaccccaagctggcccccgagctcatctacgggcaccacgcccacttcaaccggcacgaggagaacaaggccaccctgcgcaagcacctgtactccaacatcatgcggttcttcaacaaccccgacagcaaggtgtccaaggacatctgggactgcaaccgcgacctcccgatcgtgaaggacgtcatctacaacagccagatcaacttcgtgaagcggaccatgatcaagaagggcgcgttctacaaccagaaccccgtggggaagctgaacaagcagatcgccgccaacaaccgctaccccctgaagacgaaggtctccagcctcgacacctccatctacggcgggtacggcccgatgaacagcgccctgtccatcatcatcatcgccgagcggttcaacgagaagaagggcaagatcgagaccgtgaaggagttccacgacatcttcatcatcgactacgagaagttcaacaacaaccccttccagttcctgaacaacgtgagcgaggaggggttcctcaagaagaacgacctgaaccgcgtcctggcgttctaccggatctccaagtacagcctcatgcagaagatcgacggcacccgcatgctgttcgagtccaagagcaacctgcacaaggtgacgcagttcaagctcaccaagacccagaacgagctgttcttccacatgaagcggctgctcaccaagtccaacctgatggacctcaagagcgagagcgccatcaaggagtcccagaacttcatccagacgcaccagaacgagttcgacaacatcgccgaccgcctgagcaactactcccagaagatgctgggggagaccaagagcctgcagaccctcatcaacggctacaacgagcgccccatcaagcagatcgacaacaacgaggagaccatccggtactactacgacaacttcatcaagatgttctccttcgtcaagagcggggcccccaaggacatcatcaacttcttcaacgacaagtacacggtgccgcgcatgcggcccaagcccgaccgcaagatgctggacgcgaccctgatccaccagtccatcaccggcctctacgagacccggatcgacctgagcaagctgggcgaggactga

SEQ ID NO: 2165 - RNA, 4263 nt, synthetic construct
  misc_feature 1..4263: note = Cas9 variant
  source 1..4263: mol_type = other RNA
atgagccgcaagaactacgtggacgactacgccatctccctggacatcggcaacgccagcgtcgggtggtccgcgttcacccccaactaccggctcgtgcgcgccaagggccacgagctgatcggggtgcggctgttcgacccggccgacaccgccgagagccgccggatggcccgcacgacccggcgccggtactcccgccggcgctggcggctccgcctgctggacgccctcttcgaccaggccctgagcgagatcgacccctccttcctggcccggcgcaagtacagctgggtccaccccgacgacgagaacaacgccgactgctggtacggctccgtgctgttcgacagcaacgagcaggacaagcggttctacgagaagtaccccaccatctaccacctccgcaaggcgctgatggaggacgactcccagcacgacatccgggagatctacctcgccatccaccacatggtgaagtaccgcgggaacttcctggtcgagggcaccctggagagctccaacgccttcaaggaggacgagctcctgaagctgctcggccggatcacgcgctacgagatgagcgagggggagcagaactccgacatcgagcaggacgacgagaacaagctggtggccccggccaacggccagctggcggacgccctctgcgccacccgcgggagccggtccatgcgcgtggacaacgccctggaggccctgagcgcggtcaacgacctctcccgggagcagcgcgccatcgtgaaggccatcttcgccggcctggaggggaacaagctggacctcgccaagatcttcgtgagcaaggagttcagctccgagaacaagaagatcctgggcatctacttcaacaagagcgactacgaggagaagtgcgtccagatcgtggactccggcctgctcgacgacgaggagcgggagttcctggaccgcatgcaggggcagtacaacgcgatcgccctgaagcagctcctgggccggagcacctccgtgagcgactccaagtgcgccagctacgacgcccaccgcgccaactggaacctgatcaagctccagctgcggaccaaggagaacgagaaggacatcaacgagaactacgggatcctggtcggctggaagatcgactccggccagcgcaagagcgtgcgcggggagtccgcgtacgagaacatgcggaagaaggccaacgtgttcttcaagaagatgatcgagacgagcgacctctccgagaccgacaagaaccggctgatccacgacatcgaggaggacaagctgttccccatccagcgcgacagcgacaacggcgtcatcccccaccagctccaccagaacgagctgaagcagatcatcaagaagcaggggaagtactaccccttcctgctcgacgccttcgagaaggacggcaagcagatcaacaagatcgaggggctgctgaccttccgggtgccgtacttcgtgggccccctcgtcgtgcccgaggacctgcagaagtccgacaacagcgagaaccactggatggtgcgcaagaagaagggcgagatcaccccctggaacttcgacgagatggtcgacaaggacgcctccgggcggaagttcatcgagcgcctggtgggcacggacagctacctgctcggggagccgaccctgcccaagaactccctgctctaccaggagtacgaggtcctgaacgagctgaacaacgtgcggctcagcgtgcgcaccggcaaccactggaacgacaagcgccggatgcgcctggggcgggaggagaagaccctgctctgccagcgcctgttcatgaagggccagacggtcaccaagcggaccgcggagaacctgctccgcaaggagtacggccggacctacgagctgagcgggctgtccgacgagagcaagttcacgtccagcctctccacctacggcaagatgtgccgcatcttcggggagaagtacgtgaacgagcaccgggacctgatggagaagatcgtggagctgcagaccgtcttcgaggacaaggagaccctcctgcaccagctgcgccagctcgagggcatcagcgaggccgactgcgccctgctggtgaacacgcactacaccgggtggggccggctctcccgcaagctgctgaccaccaaggccggcgagtgcaagatcagcgacgacttcgcgccccggaagcactccatcatcgagatcatgcgcgcggaggaccggaacctcatggagatcatcacggacaagcagctggggttcagcgactggatcgagcaggagaacctgggcgccgagaacgggtccagcctcatggaggtggtcgacgacctgcgcgtgtcccccaaggtgaagcggggcatcatccagagcatccgcctgatcgacgacatctccaaggccgtcggcaagcggccgagccgcatcttcctcgagctggccgacgacatccagccctccgggcggaccatcagccgcaagagccgcctgcaggacctctaccggaacgccaacctgggcaaggagttcaaggggatcgcggacgagctgaacgcctgctccgacaaggacctccaggacgaccgcctgttcctgtactacacccagctcggcaaggacatgtacaccggggaggagctggacctggaccggctcagctccgcctacgacatcgaccacatcatcccccaggccgtgacgcagaacgacagcatcgacaaccgcgtgctggtcgcccgggcggagaacgcccgcaagaccgactccttcacctacatgccccagatcgccgaccggatgcgcaacttctggcagatcctgctcgacaacggcctgatcagccgggtgaagttcgagcgcctgacccggcagaacgagttctccgagcgcgagaaggagcggttcgtgcagcgcagcctcgtcgagacgcggcagatcatgaagaacgtggccaccctgatgcgccagcggtacggcaactccgcggccgtgatcgggctgaacgccgagctcaccaaggagatgcaccgctacctgggcttcagccacaagaaccgggacatcaacgactaccaccacgcccaggacgccctgtgcgtcgggatcgcgggccagttcgccgccaaccgcgggttcttcgccgacggcgaggtgtccgacggcgcccagaacagctacaaccagtacctccgcgactacctgcgggggtaccgcgagaagctgtccgcggaggaccggaagcagggccgcgccttcgggttcatcgtgggcagcatgcggtcccaggacgagcagaagcgcgtcaacccgcggaccggggaggtggtgtggagcgaggaggacaaggactacctccgcaaggtcatgaactaccggaagatgctggtgacccagaaggtgggcgacgacttcggcgccctgtacgacgagacgcgctacgccgccaccgaccccaaggggatcaagggcatccccttcgacggggcgaagcaggacacctccctctacggcgggttcagctccgccaagcccgcctacgccgtcctgatcgagagcaagggcaagacccggctggtgaacgtgacgatgcaggagtacagcctcctgggcgaccgcccgtccgacgacgagctgcggaaggtcctcgcgaagaagaagtccgagtacgccaaggccaacatcctgctgcgccacgtgcccaagatgcagctcatccggtacgggggcgggctgatggtgatcaagagcgccggcgagctgaacaacgcccagcagctctggctgccctacgaggagtactgctacttcgacgacctgagccagggcaaggggtccctcgagaaggacgacctgaagaagctgctcgacagcatcctgggctccgtccagtgcctgtacccctggcaccgcttcaccgaggaggagctcgcggacctgcacgtggccttcgacaagctgccggaggacgagaagaagaacgtgatcaccgggatcgtcagcgccctccacgccgacgccaagaccgcgaacctgtccatcgtgggcatgacggggagctggcggcgcatgaacaacaagtccggctacaccttcagcgacgaggacgagttcatcttccagtcccccagcggcctgttcgagaagcgggtgaccgtcggggagctcaagcgcaaggccaagaaggaggtgaactccaagtaccggaccaacgagaagcgcctgcccacgctgagcggcgcctcccagccgtga

SEQ ID NO: 2166 - RNA, 4263 nt, synthetic construct
  misc_feature 1..4263: note = Cas9 variant
  source 1..4263: mol_type = other RNA
atggccaagcccaaggactacaccatcggcctggacatcgggaccaacagcgtgggctgggtcgtgacggacgaccagaacaacatcctccgcatcaaggggaagaaggccatcggcgcgcggctgttcgccgaggggaaggtggccgccgagcgccggtccttccgcaccacccggcgccggatcagccgccggcgctggcggatcaagctgctcgaggagctgttcgacgaggagatcgccaaggtcgacccgtccttcttcgcgcgcctgcacgagagctggatctcccccaaggacaagcggaagcgctacagcgccatcgtgttcccctcccccgaggaggacaagaagttccacgagagctacccgaccatctaccacctccgggacaagctgatgaaggacgaccagaagcacgacatccgcgagatctacatcgccgtgcaccagatgatcaaggtccggggcaacttcctgcacgacgagtccgtggagacgtaccgcagcggcatgtccagcctcgggggccggtccgagcgcaccatcctgagcgtgcagaccctggaggagctcaacgacctgttcgccgagaacgaggggaccgaggaggtcgagctgaacgtggcgtccgccgagcagatcaacgacatcctcacgggcgaccacctgaacgccgacagccagaaggagatctccaacctgctcctgcccagctccttccccagcttcgacgacaaggccaaggagaagcaggtcaagaagctgatcaacaacgtggccaccaacatcagcaaggcgtggctcgggtacaaggccgacttctccaccatcctgaacctggccaaggtggacaaggaccagaagaagatcttcgccttcgccctccagggcggcgacgaggaggacaaggtgcaggagctggagagcctgctcgagcagtcccagaccgacatcgtcgaccggctgatcgagatccgccacgcgatcgtgctgagcgagatcgtgcccgtcgggatgacgctctccgaggccatgatcgacaagtacgaccagcacaaggaggacctgatcaccctgaaggccgtgatccgcaacaccaaggacaagaagaaggccgccaagctccaggcgatctacgacctgtacgtgaacaaccggcacgccgacctggccaaggccatgaagctcaccggcatcaagaagcgcagcgagctgctggacccggaggagctcaagaaggccatctccagcctgctggacgactcccccgaggcgggggagatcaagcagcggctcgagggcaagacgttcctgcccctgcagcgcagcaacaacaacggcgtcatccccaaccagctccaccaggtggagctggacgagatcatcaagaagcagtccaagtactacccgttcctggccgagaagaaccccgacgagagcgaggaggcccagaagaaggcccccaccaagctcgacgcgctgctgaccttccgggtgccctactacgtcgggccgatgatcaccaaggaggagcaggaggcccaggacggccactccttcgcctggatggtgcgccgggacccccaggaccacgaggccatcacgccctggaacttcgagaagaaggtcgacaagatggccagcgcgacccagttcatcaagcgcatgaccaccaaggacacgtacctgctcggggaggacgtgctgcccgcctccagcctgaagtaccagctgttcaccgtgctcaacgagctgaacaacctccgggtcaacggcaagaagctgacctccgacgagaaggagcaggtcatcgaggggctgttcaagaagcagaagaccgtgaaggccgacaagttcgtgaagtactggcaggccatccacatcggcgccgacatcaaggtgaagggcctcagcgacccgtccaagttcaacagcacgatgagcacctacatcgacttcaagaagatcttcggggaccagctgaacgacgcgaaccgccagaacgacttcgagaagatcatcgagtactccaccatcttcgaggaccggaagatcctggaggacaagctccgcgccgacttcgcctggctgagcgaggagcagatcaagcagctgtgccggctccgcctgcagggctgggggcggctgtccgacaagctcctgacccgcctgacggacgccgacggccagaacgtgctcgagcggctgtggaacagcaacgacaacttcgtccagatcgtgtccgaccccaacatcaaggccaagatcgagcaggagaaccagaagctgctccgcgacgggcagagcgacgacgcggtggagtccatcctggacgacgcctacaccagcccccagaacaagaaggccatccggcaggtcatgcgcgtggtgcacgacatcgtcaaggcctgcgacggcaacgtgcccgcgaagttcgccatcgagttcgcccgctcccaggaggacgacccgaagcggaccaccgcccgcgtgaaccagatgcagaagatctacgaccagatcagcgacgaggtcgtgtcccagggcgtgaaggagcagctgagcgggatgaagtccctcaaggaccggtactacctgtacttcatgcagggcgggcgcgacgcctacacgggcgcgaagctgaacatcgaccggctcagcgactacgacatcgaccacatcatgccccagtccttcgtcaaggacgacagcctggacaaccgcgtgctggtggcccgggccgtcaacaaccagaagtccgacaaggtgcccgccttcctcttcgggaacaaggtggtcgccgacctgggcatcaccgtgcgcgagatgtgggacaagtggcagaagctgggcatgatcagcaagcggaagctcagcaacctgctgaccgaccccgacgcgctcaccgagtaccgcgcccaggggttcatccggcgccagctggtggagacctcccaggtcatcaagctgacggccaccatcctccagagcgagttcccggactccaagatcatcgaggtgcccgccaagtacaacagcatcgtgcggaagcagttcgacctgtacaagtcccgcgaggtcaacgacttccaccacgccatcgacgcgtacctgagcaccatcgtgggcaactacctctaccaggtgtaccccaacctgcggcgcatgttcgtctacggggagttcaagaagttctccagcaacgccgaggagtccgcccacgacatggcccggcgcgtcaagagcatgaacttcctggacgacctcctgcggggcacccacggcgacaacatctactgccgctccacgggggagatcgtgttcaaccggaacgacatcatcagcaagctgaagcaggcgtactccttcaagcagatgctcgtgacccaggaggtgttcacccgcaagagcgccctgttcgaccagaccgtgtacccgtcccccgagcgcgacagcaagaagcggtccggcctgatcccccgcaagaaggggatggacacggagatctacggcgggtacagcggcaacaaggacgcctacttcgtcctcgccgaggccgtgaaggagaagggccacaccctgcagatcgtgggggtccccatccgggcgctgaacaccctcaagaactccgccaactacagcgagaagctgctggagatcatcaagccccaggtgatgttcaacaagaagaacggcaagccgaagaagggggtgaacgacgtccgcatcctcatggacaacatcccctaccggcagcccgtgctggagggcggggccctgtacatgctcggcagctccacctacaagtacagcctgaagcagatcacgctgtcccaggagagcatgaagtacatcctcgactacatcgacgacccgtccttcaacaagcacatcatggtgaacatcgaccaccaggacgagaagaagtgcctgctgagcgtctacgacgagatcctcgacaagatggacaagtacctgcccctgttcgacatcaacggcttccgcaagaagctccacgacgggcgggagaagttcgtgaagctgcccgtcgagaagcaggccgaggtggtgaaggacatcctgcgcggcctccacgccaactccgagatgaccaagcccagcgacctggggctgaccaccgcgctcggcttcatgcaggccccggacgggatcaagatctccgacgacgccgtcttcatctaccagagccccacgggcctgttcgagcggcgcgtgaaggtgtccgacctgctcaagtga

SEQ ID NO: 2167 - RNA, 4266 nt, synthetic construct
  misc_feature 1..4266: note = Cas9 variant
  source 1..4266: mol_type = other RNA
atgaccaagttcaacaagaactacagcatcggcctggacatcggggtgtccagcgtcggctacgccgtggtgaccgaggactaccgcgtccccgccttcaagttcaaggtgctcgggaacacggagaaggagaagatcaagaagaacctgatcggctccaccaccttcgtgagcgcgcagccggccaaggggacccgggtcttccgcgtgaaccggcgccggatcgaccgccggaaccaccgcatcacgtacctgcgggacatcttccagaaggagatcgagaaggtggacaagaacttctaccgccggctcgacgagtccttccgcgtcctgggcgacaagagcgaggacctgcagatcaagcagcccttcttcggcgacaaggagctcgagaccgcctaccacaagaagtaccccaccatctaccacctccggaagcacctggccgacgccgacaagaactcccccgtggcggacatccgcgaggtgtacatggccatcagccacatcctgaagtaccgggggcacttcctgaccctggacaagatcaacccgaacaacatcaacatgcagaactcctggatcgacttcatcgagagctgccaggaggtcttcgacctcgagatctccgacgagagcaagaacatcgccgacatcttcaagtccagcgagaaccgccaggagaaggtgaagaagatcctgccctacttccagcaggagctgctcaagaaggacaagtccatcttcaagcagctgctgcagctcctgttcggcctgaagacgaagttcaaggactgcttcgagctcgaggaggagcccgacctgaacttcagcaaggagaactacgacgagaacctggagaacttcctcgggtccctggaggaggacttcagcgacgtgttcgccaagctgaaggtcctccgggacaccatcctgctgtccggcatgctcacctacaccggggcgacgcacgcccgcttcagcgccaccatggtggagcggtacgaggagcaccgcaaggacctgcagcggttcaagttcttcatcaagcagaacctgagcgagcaggactacctcgacatcttcggccgcaagacccagaacggcttcgacgtggacaaggagaccaaggggtacgtcggctacatcacgaacaagatggtgctgaccaacccccagaagcagaagaccatccagcagaacttctacgactacatctccgggaagatcaccggcatcgagggcgccgagtacttcctgaacaagatcagcgacgggacgttcctccgcaagctgcggacctccgacaacggcgccatcccgaaccagatccacgcgtacgagctggagaagatcatcgagcgccaggggaaggactaccccttcctcctggagaacaaggacaagctgctcagcatcctgaccttcaagatcccctactacgtgggccccctggccaaggggtccaacagccggttcgcctggatcaagcgcgccacctccagcgacatcctcgacgacaacgacgaggacacgcggaacggcaagatccgcccgtggaactaccagaagctgatcaacatggacgagacccgggacgccttcatcaccaacctgatcggcaacgacatcatcctcctgaacgagaaggtcctgcccaagcgctccctgatctacgaggaggtgatgctccagaacgagctgacccgggtgaagtacaaggacaagtacgggaaggcgcacttcttcgacagcgagctgcgccagaacatcatcaacggcctcttcaagaacaactccaagcgggtcaacgccaagagcctgatcaagtacctgtccgacaaccacaaggacctcaacgccatcgagatcgtgagcggggtcgagaagggcaagtccttcaacagcacgctgaagacctacaacgacctgaagaccatcttctccgaggagctcctggacagcgagatctaccagaaggagctggaggagatcatcaaggtgatcaccgtgttcgacgacaagaagtccatcaagaactacctcacgaagttcttcgggcacctggagatcctggacgaggagaagatcaaccagctcagcaagctgcgctacagcggctggggccggtactccgccaagctgctcctggacatccgcgacgaggacaccgggttcaacctgctccagttcctgcggaacgacgaggagaaccgcaacctgaccaagctcatcagcgacaacaccctgtccttcgagcccaagatcaaggacatccagagcaagtccacgatcgaggacgacatcttcgacgagatcaagaagctggccggcagccccgcgatcaagcgggggatcctcaactccatcaagatcgtcgacgagctggtgcagatcatcggctacccgccccacaacatcgtgatcgagatggcccgcgagaacatgaccaccgaggaggggcagaagaaggccaagacccggaagaccaagctggagagcgccctcaagaacatcgagaactccctgctggagaacggcaaggtcccccacagcgacgagcagctccagtccgagaagctgtacctgtactacctccagaacggcaaggacatgtacacgctggacaagaccgggagccccgccccgctgtacctcgaccagctggaccagtacgaggtggaccacatcatcccctactccttcctgcccatcgacagcatcgacaacaaggtgctcacccaccgcgagaacaaccagcagaagctgaacaacatccccgacaaggagaccgtcgcgaacatgaagccgttctgggagaagctgtacaacgccaagctcatctcccagacgaagtaccagcgcctgaccaccagcgagcggacccccgacggcgtgctgacggagtccatgaaggccgggttcatcgagcgccagctcgtggagacccggcagatcatcaagcacgtcgcccgcatcctggacaaccggttcagcgacaccaagatcatcaccctcaagagccagctgatcacgaacttccgcaacaccttccacatcgcgaagatccgggagctgaacgactaccaccacgcccacgacgcctacctggccgtggtggtcggccagaccctcctgaaggtgtaccccaagctggcccccgagctcatctacggccaccacgcgcacttcaaccgccacgaggagaacaaggccaccctgcggaagcacctgtactccaacatcatgcgcttcttcaacaacccggacagcaaggtgtccaaggacatctgggactgcaaccgggacctccccatcatcaaggacgtcatctacaacagccagatcaacttcgtgaagcgcacgatgatcaagaagggggccttctacaaccagaaccccgtgggcaagttcaacaagcagctggccgccaacaaccggtacccgctgaagaccaaggcgctctgcctggacacctccatctacgggggctacgggcccatgaacagcgccctgtccatcatcatcatcgccgagcgcttcaacgagaagaagggcaagatcgagaccgtcaaggagttccacgacatcttcatcatcgactacgagaagttcaacaacaaccccttccagttcctcaacgacacgagcgagaacggcttcctgaagaagaacaacatcaaccgggtgctggggttctaccgcatccccaagtactccctcatgcagaagatcgacggcacccggatgctgttcgagagcaagtccaacctgcacaaggccacccagttcaagctcaccaagacgcagaacgagctgttcttccacatgaagcgcctgctcaccaagagcaacctgatggacctgaagtccaagagcgccatcaaggagtcccagaacttcatcctcaagcacaaggaggagttcgacaacatcagcaaccagctgtccgcgttcagccagaagatgctggggaacaccacctccctcaagaacctgatcaagggctacaacgagcggaagatcaaggagatcgacatccgcgacgagacgatcaagtacttctacgacaacttcatcaagatgttcagcttcgtcaagagcggggccccgaaggacatcaacgacttcttcgacaacaagtgcaccgtggcccggatgcgccccaagcccgacaagaagctgctcaacgccaccctgatccaccagtccatcaccggcctgtacgagacgcgcatcgacctcagcaagctgggcgaggactga

SEQ ID NO: 2168 - RNA, 4266 nt, synthetic construct
  misc_feature 1..4266: note = Cas9 variant
  source 1..4266: mol_type = other RNA
atgaagaagatcctgggcctcgacctggggcccaacagcatcggctgggccctggtgaacgaggccgagaacgagaacgagaagtccagcatcatcaagatcgggtcccgcgtcatccactacggcgacaacctcgtgaaggtggacaagagcgggaagatctccgcgagcatgaccccggaggaggacttctccagcggcaagggcctgtcccccaacgccgggcggaccaagcagcgcagcgcccggcgcaacctgcagcggtacaagcagcgccggaacaacctcatcgagatcctgaaggcccactccctgatcgacaacaacttcatcttcagcgaggagggcaacgagacgaccttcaagacctacaagaaccgcgccctcgcggccaccaacgagatctccctggaggacttcatcaaggtcctgttcatgatcaacaagaagcgggggtacaagagctcccgcaaggccaagggcgacgaggacgggcagctcatcgacggcatggccatcgcgatccagctgtacgagcacaaccagacgcccggccagttcgtgtacaacctgctcaagaacgggaagaagaacatccccgacttctaccggagcgacctgcagaccgagttcgaccgcatctggaacttccagaaggccttccaccaggagtccctgagcgacggcatctgcgagaagctcgtggggcagaagaagaacgtcacctccgccatcctgttcaaggagttcaagatcgagagcctggagatcaagggcaagtgggacgagaagcggttcttccgctacgagctccggaacaaggccgtgcagcaggagctgaagctgaacgagatcgccgagtgcctcgtggagatcaacggcgagatcagcaactccagcgggtacctgggcgcgatctccgaccgcagcaaggagctggtcttccagaagatcaccgtggggcagtacctctacaagcagatcgccgccaacccgaacacgtccctgaagaagcagatcttctaccggcaggactacctggacgagttcaacaccctctgggagacccaggccaagtaccacaaggagctgaccgacgagctgaagacgcagatccgcgacgtgatcatcttctaccagcggcgcctcaagagccagaagggcctgatctccttctgcgagttcgagagcaagcagatcgaggtcttcgtggacgggaagaagtccatcaagacccggggcatgcgcgtgatccccaagagcagccccctgttccaggagttcaagatctggcagatcctcaacaacatcgagatcaccgacctgaagaccaaggagagccgcgagctgacggacgacgagcggcagctcctgttcgaggagctgaacatccgccccaagatctccaagaaggaggccctcaagatcctgaccgagaagccggcgcagtacgacctgaactacaaggacatcgagggcaacaagaccaacgccaagttctacgaggcctacaacaagatcatccacctcagcgggcacgacgagatcgacttcaccgacaagacgtccgacatcaacgagtacctgaagcagatcttcagcctgctcggcatcaagcccgagatcctggacttcgactccagcctgaaggacgaggacttcgagaagcagctgcacttccagctctggcacctcctgtactccttcgagggggacaacaccaagaccggcgacgagaagctgctgcagaagctgaacaccaagttcgggttccccgtcgagtacgccaaggtgatcagcaacatcgccctccccgacgactacggcagcctgtccgcgaaggccatccggaagatcctgccgcacctcaaggacggcttcagctacgggggccgcaagtcccggcccgacgagcccagcgcctgcgagtacgccgggtaccgccactccaaggccagcctgacgaaggacgagaaggagaacaagacctacaaggacaagctggagatcctccccaagaactccctgcggaacccgatcgtggagaagatcctgaaccagaccatcaacgtcgtgaacgcggtgatcggcgactacgggaagcccgacgagatccgcctcgagctggcccgggagctgaagaagtccgccgaggagcgccaggacgccaccgactccatcagcaaggcgacggccaagcacgagaagtaccggaaggtcctccagaccgagttcggcctgaagcacatctcccgcaacgacctgatccggtacaagctctacctggagctgaagaacaacggcttcaagaccctctacagcgacacctacatcgccccctacgagatcttctccaagaagttcgacatcgagcacatcctgcccaaggccaagctgttcgacgacagcttctccaacaagacgctcgagctcaagagcgtgaacctgaagaagggggacatgaccgcctacgacttcgtgaaggaggagtacggcaccgaggggctggcgaagtacgagcagcgcgtccaggacctgttcctgaacaagaagcggaacgaggacctcgaccaggagaacgagtcccgcatcaccgacgagaagatcagcaagacgaagcgggacaagctgctgatgccggagaacaagatccccaccggcttcatcgaccgcgagctccgggacagccagtacatcgccaagaaggccaagaccatgatggaggacatctgcaaggacgtggtcaccaccacgggctccgtgaccgaccgcctgcgcgaggactggcagctgatcgacatcatgcaggagctcaactggcccaagtacgccgccctggggctgaccgaggagttcaccaacgaggagggcaacgtgatccggaagatcaaggactggacgaagcgcaacgaccaccggcaccacgcgatggacgccatcaccatcgccttcaccaagcgcagccacatccagtacctcaacaacctgtccgcccggagcgacaagtccagctccatctacgggatcgagcagaaggagctgtaccgcgacaagaacaacaagctccggttcgcgcccccgatccccatcaacgagttccgcgccgaggccaagatgcagctggagaacaccctgatcagcatcaaggcccagaacaaggtcgtgacgaagaacaagaacaagatctccggccagaagaagctccaggagaccctgacgccccgggggcagctgcacctcgagaccatctacggcaagatcaaccagtaccagaccgccgagatcaaggtgggcgggaccctggacagcgagctgatcaacaaggtcgcgaacaagaagacccgcgaggccctcctgaaccggctggccgagttcggcaacgaccccaagaaggccttcaccgtgaagaacacgatcgacaagaacccgatctacctcgacaagcaccagtcctacaagatccccgagaaggtgaagatcgtctggcaggagcccgtgtacaccatccgcaagagcatcaccccggacctgaagctggacaagatcatcgaccccaagatcaaggccctcctggagtcccggctgaaggagtgcaacggggacgcgaagctcgccttcagcaacctggccgagaaccccatctggctgaacaaggagaagggcatccagatcaagcgcgtgaccatcacggggatctccaacgccgccagcctccacgacaagaaggacctgaacggcaagcccatcctggacgagaagggcaacaagatctccgtcgacttcgtgaacaccgggaacaaccaccacgtggcgatctacaaggacgagaacggcaacctccacgacaacgtcgtgaccttcttcgaggccgtggagcgggtcaaccagaacctgccggtggtggacaagctgttcaagcagaaggaggggtggcagttcctcttcaccatgaagcagaacgagtacttcgtcttccccaacgagatcacggccttcaaccccaacgagttcgacctgctgaaccccgacaactactacctcatcagcccgaacctgttccgcgtgcagaccatgtccaaggtgatgtacggcaacaacaccctgcgggactacaagttccgccaccacctcgagaccacgctgcaggacatcaaggagctgcgggacatcgtcttcaagcagttcaagagcctcagcatcttcgacaagatcgtgaaggtgcgcatcaaccacctggggaagatcgtcaagaccggcgagtactga

SEQ ID NO: 2169 - RNA, 4266 nt, synthetic construct
  misc_feature 1..4266: note = Cas9 variant
  source 1..4266: mol_type = other RNA
atgaaggacatcctgggcctcgacctggggaccaacagcatcggctgggccgtggtcaaggaggcccagaacgacaacgagcagtccgagatcgtggacgtgggggtccgcgtgaaccccctgaccacggacgagaagaccaacttcgagaagggcaagccgatcagcaccaacgcggaccggaccctcaagcgctccgcccggcgcaacctgcagcggtacaagctgcgccggaaggagctcatcgagctgctgaaggagcaccagctcatcagcacggacaccatcctgaccgagaacgggaagggcaccacgttccagaccctggagctccgcgccaagtccgccaaggagaagatcagcctggaggagctggcccgggtgttcctcaccatcaacaagaagcgcggctacaagtccagccggaaggcgaagaacgaggacgaggggcagctgatcgacggcatggagatcgccaagcgcctgtacgaggagaacctcaccacggggcagctgtccctgcagctcctgaaggagggcaagaagtccctgcccgactactaccggtccgacctccagttcgagctggacaaggtctggaacttccagaagcagttccacagccacatcctgaccgacgagttctacgcccagctcaaggggaagggccagcgcgccacctccgcgctgttcctggccaagtaccagatctacaccgccgagaacaagggcagccgggaggacaagaagctccaggcctaccagtggcgcgtggacgccctgtccaaggagctgacgcgggagcagctcgcgttcgtgatcaccgagatcaacaacaacctgaacaacagctccgggtacctgggcgccatcagcgaccgctccaaggagctctacttcaacaacgagaccgtcggggagtacctgtggaagcagatcgccgccaacccccacaccagcctgaagaaccaggtgttctaccggcaggactacctcgacgagttcgagcagatctggaagacgcagagcgccttctaccccgagatcctgaccgagtccctgaagaaggagctccgcgacgtggtcatcttctaccagcggaagctcaagagccagaagtccctggtgagcttctgcgagttcgagaacaaggagatcgagatcaagaaggaggacggcacctccaccaagaaggtgatcggcctcaaggtcgcgcccaagagcagccccctgttccaggagttcaagatctggcagaacctgaacaacgtgctcatccgcaagaaggggagcaagacgaagaaggccgccaagaaccagcaggccgtgctgttcgaggaggagaagaccatctccgagctggacctggaggccaagcaggcgctgttcaacgagctgaacctgaagggcaacctcaaggccgactactgcctggagatcctggggtacagccccaaggagtgggagatgaactactccgtcctcgagggcaaccgcaccaacaaggccctgtacgaggcctacctgaagatcaccgacctcgaggggtacgacgccaagaaccacctgaaggtgaagctgaacaaggacgaggtggagctcgacgacctgaaggtccccgcgagcgagatcaaggacatggtgcaggccatcttcaaggaggccggcatcaacacggacatcctgcacttcaacgccgagctcgacggcaaggacttcgagaaccaggcgtcctaccagctgtggcacctcctgtacagctacgagggggacgactccaagagcggcaacgagctgctgtacaagctcctggagaccaagttcgggttcaagaaggagtacgcccagatcctggccaacgtgtccctcagcgacgactacggctccctgagcaccaaggccatgcggaagatccacccgtacatcaaggagaacaagttcagcaccgcctgcgagctggcggggtaccgccactccaagcacagcctcacgaaggaggagaacgacaaccgggtcctgcgcgactccctggaggtgctcaagaagaacagcctgcggcagcccgtcgtggagaagatcctgaaccagatgatcaacctcgtgaacgccctgctgaagaagtaccgcaccgagaaccccaacttcaagttcgacgagatccggatcgagctcgcccgcgagctgaagaagaacgccgaggagcgggccaacatgaccgcgaacatcaacaaggccaagaccgagcacgagaagatcatcaagatcctgaagaacgagttcggcctccccaacccgacgcgcaacgacatcatccggtaccgcctgtacgaggagctgaaggccaacggctacaaggacctctacaccaacatcaagatcccccaggagaagctgttcaccaaggagatcgacatcgagcacatcatccccaagtcccgggtcttcgacgacagcttctccaacaagaccctgagcttccgcaagaccaacctcgacaagggggagcggacggccttcgactacatggagtccaagttcggcgccgacaagctggaggagtacgtggcgcgcgtggaggacctgtacaagaacaacatcatcagcaaggccaagtaccagaagctcctgaagaaggagtccgagatcggggacggcttcgtcgagcgggacctgcgcgagacccagtacatcgccaagaaggccaaggagatcctcctgcagatcacccccaacgtgctgagcacctccgggggcatcacggaccggctccgcgaggactgggacctgatcaacgtgatgaaggagctgaacctcccgaagtaccgcgcgctgggcctgaccgagatggaggaccggaagtacgggcagcaggtcgaggtgatcatcgactggaccaagcgcaacgaccaccggcaccacgccatggacgccctcaccgtggccttcacgaagcacaaccacatccagtacctgaactacctgaacgcccgcaagaacgagaagcacaaggagcacagcaacatcatgggcatccagcagctcgagaccatcaaggtcaccgacaagaacgggaacgagaagcgggtgttcaaggcgcccatgcccaacttccgccaggtgaccaaggccttcctggagaacatcctgatctcccacaaggccaagaacaaggtcgtgacgaagaacaagaacaaggtggccggcagcaacaaggtccaggaggtgctcaccccgcggggccagctgcacaaggagaccgtgtacgggaagtaccagtactacgtccagaaggaggagaagatcggcgggaagttcgacctggagaccatcaagaaggtggccaacccgctctaccagtccctgctgaagaagcgcctcgaggagaacggcggggaccccaagaaggcgttcacgggcaagaacagcctggccaagaaccccatctacctggacgacgcccagaccgagcagctccccgagaaggtgaagctggtctggctggagaacagcttctccatccggaaggacatcaccccggagaacttcaaggacgagaagctcatcgacaagatcctggacgagggcgtgaagcgcatcctgaaggagcggctccagagcttcgggaacgacgccaagaaggccttctccgacctggagaagaaccccatctggctgaacaaggagaagggcatcaccatcaagcgcgtgacgatcagcggggtcgcgaacgccgagcccctccacaccaagaaggaccacctgggcaaggagatcctggacaaggaggggaagcccatcccggtggacttcatctccaccggcagcaaccaccacgtggccgtctaccgggacgagaagggcaacctccaggagaaggtggtgtccgtcttcgaggccgtggtgcgcgcgaaccaggggctgcccatcatcgacaagacctacaaccagcacctgggctgggagttcctcttcacgatgaagcagaacgagatgttcgtcttccccaacgagagcaccgggttcaacccgaacgacatcgacctgctggaccccaagaacaagcggatcatctcccccaacctcttccgcgtgcagaagctggccaccggcgactactggttccggcaccacctggagaccacggtggagaccaagagcgccaccaaggacatgacctacaagcgcctgtccctcaaccacatcaagaacatcatcaaggtccggatcagccacctgggggacatcgtgtccgtgggcgagtactga

SEQ ID NO: 2170 - RNA, 4275 nt, synthetic construct
  misc_feature 1..4275: note = Cas9 variant
  source 1..4275: mol_type = other RNA
atgaagcgcatcctgggcctcgacctggggaccaacagcatcggctgggccctggtgaacgaggccgagaccgacgaggaggtctccagcatcatccggctcggggtgcgcgtgaaccccctgacggtcgacgagacccagaacttcgagaagggcaagtccatcaccaccaacgcggagcggacgctgaagcgcagcatgcggcgcaacctccagcggtacaagctgcgccgggacgccctggtggagttcctcaaggagctggggttcatcaccgacgagaccatcctgtccgagcagggcaaccgcaccacgttcgagacctgccggctccgcgccaaggccgccgaggaggagatcagcctggaggagctgtcccgggtgctcctgatgatcaacaagaagcgcggctacaagagctcccggaaggtcaagaaggaggaggacggggtgctgatcgacggcatggagatcgcgaagaagctctacgaggaggacctgaccccggggcagctgtgcagccagctcctggagtccggcaagaaggtgctgcccgacttctaccgcagcgacctccaggaggagctggaccggatctggtccgtccagaagcagttccaccccgacgtgttctgcgacgccgccaaggaggagatcaaggggaagaaccgcagccagacctgggccatcctggcgaactacttcgtgtggaaggaggaggtcgtgggctggaacgaccgggaggccaagaacgagacgatcgagaaggagtgcaagctcgtgggcctgaagcgcaccaccaaggggtacgagctgaagaaggagaactaccggtggcgcgcccaggccctcaccgagcagctgggcctggaggagatcgccgtcgtgctccaggagatcaacgggcagatcaacgcgtccagcggctacctgggcgccatctccgaccgcagcaaggtgctgtacttcaaccaccagacggtcgggcagtaccagatggccgagctcgacaagaacccccacgcctccctgcggaacatggtgttctaccgccaggactacctggacgagttcgaccggatctgggagaagcaggccgagttccacaaggagctcaccgcggagctgaagaaggagatccgcgacatgatcatcttctaccagcggcgcctcaagagccagaagggcctcatcagcttctgcgagttcgagcggctggagatcgtggtcgagaaggacgggaagaagcagaccaaggtgatcggctgcaaggtgatcccgcgctcccaccccctgttccaggagttcaaggtctggcagaccctcaacgacatcaaggtgctggggcgggagaagaagcgcaacgccctgagcgcctccgagagccgggccctctaccccgaggagaaggagatcctggcccgcgagctggcgatcaaggagaacatgaagaaggccgacgtcctgaagctcctgttcgagaacccccaggagctggacctcaacttcaagcagatcgacggcaaccggacgggcttctccctgttcagcgcctactccaagatgatcgagaagtacgggtacgagccgctggacttcaagaagcccgccgacgagatcatcggccagctccgcaccatcttcaccgacctggggtggaacaccaacctgttcacgatcgacctcaccaaggagggcaaggagctggagatgcagccctacttccggctgtggcacctcctgtacagcttcgagggggacaacacctccaccggcaacggcaagctgatcgagaagatcatgcagctctgcggggtggagaaggagtacgccgtggagctggcgagcctgtccttccaggacgactacggcagcctctccgccaaggccatcaagcgcatcctgccctacctgaaggaggggaacctctacgacgtcgcctgcgagtacgcgggctaccggcacagcaagtccagcctgacgaaggaggagatcgagaacaaggtgctgaaggggaagctcgaggtgctgccgaagaactccctgcgcaaccccgtcgtggagaagatcctcagccagatggtgaacgtcatcaacaccatcatcgacacctacggcaagcccgacgagatccgggtggagctggcccgcgagctgaagaagtccgccaaggagcgcgaggagctcaccaaggccatcgccaagagcacgcgggagcacgaggagatccgcaagctgctgcaggacgagttcggcatgatgaacgtgagccggaacgacatcatccgctacaagctctacgaggagctgaaggacaacgggtacaagaccctgtactccaaccagtacatccccaaggagaagatcttcagcaaggagatcgacatcgagcacatcatcccgcagtcccggctgttcgacgacagcctgtccaacaagaccctggagtacaaggcgatcaacatcgagaagggcaacaagaccgcctacgacttcgtcaaggagaagtacggggaggagggcctccagcagtacatcaaccgctgcgagagcctgttcaacgacaagaaggccaagctgcggaagctcaagatggagcagaaggacatccccgacggcttcatcgaccgcgacctgcggaacacgcagtacatcgccaagaaggccctggcgatgctcaacgagatctgccgccgggtggtggccaccaccgggtccatcaccgaccagctgcgcgaggactggcagctggtcgacgtgatgaaggagctcaacctgcccaagtacgaggccctgggcttcgtggagacctacgaggacaaggacgggcggaagatcaagcgcatcaaggactggacgaagcggaacgaccaccgccaccacgccatggacgccctcaccgtcgcgttcaccaaggacgccttcatccagtacttcaacaacaagaacgccgcccaggacagcggcaaccggaaccacaccaacatcatcgggatcaagacgcgctacttcgacaagggccgggcgctgcccccgatccccctggagcagttccgcatcgaggccaagcagcacctcgagaagctgctggtgtccatcaaggccaagaacaaggtggtcaccgtgaacgtgaaccggaccaagaagcgcaagggcgagaacaccaagatccagcagacgccccgcgggcagctccacctggagaccgtctacggcagccacaagcagtacgtgaccaagatcgagaaggtgaacgcctccttcgacgccgcgaagatcgccaccgtcagcaagcgggcctaccgcaacgccctgctcaagcggctggagacgttcgggaacgaccccaagaaggccttcaccggcaagaacgcgctggagaagaacccgctctacgccgacaagtaccagaccatccgcgtgcccgagaaggtgcagaccgtcgagttcgagacgatctacaccatccggaagcccgtggaccccgccctgaacgtggacaaggtcgtggacgtgaaggtccgcgccatcctggagcggcgcctcaaggagtacgggggcgacccgaagaaggccttcgtgaacttctgggagaaccccatctggctgaacaaggagaagggcatctccatcaagcgggtgagcatccgcgggatcaacaacgcgcagtccatccacgtcaagaaggacaagaacggcaaccccatctgggacgagaacgggaagcagatcccggtggacttcgtgaacaccggcaacaaccaccacgtcgccatctaccggaagcccgtgctggacaagaagggccaggtgaccttcgacgaggacgggaacctcatgtacgagctggacgaggtcgtggtgcccttcttcgaggccgtcacgcgcgccaacctgggcctccccatcatcgacaaggactaccgcaagagcgaggggtggcagttcctgttctccatgaagcagaacgagtacttcgtgttcccgaacgagaagaccggcttcaaccccaaggaggtggacctgctcaaccccgacaactacgcgatgatcagccccaacctgttccgggtccagaccatgagcaaggtgatgtacgggaacaacgtcgtgcgggactacaagttccgccaccacctggagaccacggtgaaggacatgaaggagctcaaggacatcgcctacaagcagtacaagaccctgtccttcggcaacagcgtcgtgaagatccggatcaaccacatcgggcagatcgtgtccgtcggcgagtactga

SEQ ID NO: 2171 - RNA, 4275 nt, synthetic construct
  misc_feature 1..4275: note = Cas9 variant
  source 1..4275: mol_type = other RNA
atgaagcgcatcctgggcctcgacctggggaccaacagcatcggctgggccctggtgaacgaggccgagaccgacgaggaggtctccagcatcatccggctcggggtgcgcgtgaaccccctgacggtcgacgagacccagaacttcgagaagggcaagtccatcaccaccaacgcggagcggacgctgaagcgcagcatgcggcgcaacctccagcggtacaagctgcgccgggacgccctggtggagttcctcaaggagctggggttcatcaccgacgagaccatcctgtccgagcagggcaaccgcaccacgttcgagacctgccggctccgcgccaaggccgccgaggaggagatcagcctggaggagctgtcccgggtgctcctgatgatcaacaagaagcgcggctacaagagctcccggaaggtcaagaaggaggaggacggggtgctgatcgacggcatggagatcgcgaagaagctctacgaggaggacctgaccccggggcagctgtgcagccagctcctggagtccggcaagaaggtgctgcccgacttctaccacagcgacctccaggaggagctggaccgcatctggtccgtccagaagcagttccaccccgacgtgttctgcgacgccgccaaggaggagatcaaggggaagaaccggagccagacctgggccatcctggcgaactacttcgtgtggaaggaggaggtcgtgggctggaacgaccgcgaggccaagaacgagacgatcgagaaggagtgcaagctcgtgggcctgaagcggaccaccaaggggtacgagctgaagaaggagaactaccgctggcgggcccaggccctcaccgagcagctgggcctggaggagatcgccgtcgtgctccaggagatcaacgggcagatcaacgcgtccagcggctacctgggcgccatctccgaccgcagcaaggtgctgtacttcaaccaccagacggtcgggcagtaccagatggccgagctcgacaagaacccccacgcctccctgcgcaacatggtgttctaccggcaggactacctggacgagttcgaccgcatctgggagaagcaggccgagttccacaaggagctcaccgcggagctgaagaaggagatccgggacatgatcatcttctaccagcgccggctcaagagccagaagggcctgatcagcttctgcgagttcgagcgcctggagatcgtggtcgagaaggacgggaagaagcagaccaaggtgatcggctgcaaggtgatcccgcggtcccaccccctgttccaggagttcaaggtctggcagaccctcaacgacatcaaggtgctggggcgcgagaagaagcggaacgccctgagcgcctccgagagccgcgccctctaccccgaggagaaggagatcctggcccgggagctggcgatcaaggagaacatgaagaaggccgacgtcctgaagctcctgttcgagaacccccaggagctggacctcaacttcaagcagatcgacggcaaccgcacgggcttctccctgttcagcgcctactccaagatgatcgagaagtacgggtacgagccgctggacttcaagaagcccgccgacgagatcatcggccagctccggaccatcttcaccgacctggggtggaacaccaacctgttcacgatcgacctcaccaaggagggcaaggagctggagatgcagccctacttccgcctgtggcacctcctgtacagcttcgagggggacaacacctccaccggcaacggcaagctgatcgagaagatcatgcagctctgcggggtggagaaggagtacgccgtggagctggcgagcctgtccttccaggacgactacggcagcctctccgccaaggccatcaagcggatcctgccctacctgaaggaggggaacctctacgacgtcgcctgcgagtacgcgggctaccgccacagcaagtccagcctgacgaaggaggagatcgagaacaaggtgctgaaggggaagctcgaggtgctgccgaagaactccctgcggaaccccgtcgtggagaagatcctcagccagatggtgaacgtcatcaacaccatcatcgacacctacggcaagcccgacgagatccgcgtggagctggcccgggagctgaagaagtccgccaaggagcgcgaggagctcaccaaggccatcgccaagagcacgcgcgagcacgaggagatccggaagctgctgcaggacgagttcggcatgatgaacgtgagccgcaacgacatcatccggtacaagctctacgaggagctgaaggacaacgggtacaagaccctgtactccaaccagtacatccccaaggagaagatcttcagcaaggagatcgacatcgagcacatcatcccgcagtcccgcctcttcgacgacagcctgtccaacaagaccctggagtacaaggcgatcaacatcgagaagggcaacaagaccgcctacgacttcgtcaaggagaagtacggggaggagggcctccagcagtacatcaaccggtgcgagagcctgttcaacgacaagaaggccaagctgcgcaagctcaagatggagcagaaggacatccccgacggcttcatcgaccgggacctgcgcaacacgcagtacatcgccaagaaggccctggcgatgctcaacgagatctgccggcgcgtggtggccaccaccgggtccatcaccgaccagctgcgggaggactggcagctggtcgacgtgatgaaggagctcaacctgcccaagtacgaggccctgggcttcgtggagacctacgaggacaaggacgggcgcaagatcaagcggatcaaggactggacgaagcgcaacgaccaccggcaccacgccatggacgccctcaccgtcgcgttcaccaaggacgccttcatccagtacttcaacaacaagaacgccgcccaggacagcggcaaccgcaaccacaccaacatcatcgggatcaagacgcggtacttcgacaagggccgcgcgctgcccccgatccccctggagcagttccggatcgaggccaagcagcacctcgagaagctgctggtgtccatcaaggccaagaacaaggtggtcaccgtgaacgtgaaccgcaccaagaagcggaagggcgagaacaccaagatccagcagacgccccgcgggcagctccacctggagaccgtctacggcagccacaagcagtacgtgaccaagatcgagaaggtgaacgcctccttcgacgccgcgaagatcgccaccgtcagcaagcgcgcctaccggaacgccctgctcaagcgcctggagacgttcgggaacgaccccaagaaggccttcaccggcaagaacgcgctggagaagaacccgctctacgccgacaagtaccagaccatccgggtgcccgagaaggtgcagaccgtcgagttcgagacgatctacaccatccgcaagcccgtggaccccgccctgaacgtggacaaggtcgtggacgtgaaggtccgggccatcctggagcgccggctcaaggagtacgggggcgacccgaagaaggccttcgtgaacttctgggagaaccccatctggctgaacaaggagaagggcatctccatcaagcgcgtgagcatccgggggatcaacaacgcgcagtccatccacgtcaagaaggacaagaacggcaaccccatctgggacgagaacgggaagcagatcccggtggacttcgtgaacaccggcaacaaccaccacgtcgccatctaccgcaagcccgtgctggacaagaagggccaggtgaccttcgacgaggacgggaacctcatgtacgagctggacgaggtcgtggtgcccttcttcgaggccgtcacgcgggccaacctgggcctccccatcatcgacaaggactaccgcaagagcgaggggtggcagttcctgttctccatgaagcagaacgagtacttcgtgttcccgaacgagaagaccggcttcaaccccaaggaggtggacctgctcaaccccgacaactacgcgatgatcagccccaacctgttccgggtccagaccatgagcaaggtgatgtacgggaacaacgtcgtgcgcgactacaagttccggcaccacctggagaccacggtgaaggacatgaaggagctcaaggacatcgcctacaagcagtacaagaccctgtccttcggcaacagcgtcgtgaagatccgcatcaaccacatcgggcagatcgtgtccgtcggcgagtactga

SEQ ID NO: 2172 - RNA, 4278 nt, synthetic construct
  misc_feature 1..4278: note = Cas9 variant
  source 1..4278: mol_type = other RNA
atgcgccggaacatcctgggcctcgacctggggaccaccagcatcggcttcgccaaggtgatcgaggacgaggactaccagaactccgccgtcgagctgatcggggtgcgcgtgaaccccctcacgaccgacgagcagaccaacttcgagaagggccggccggtcagcgtgaacgcggaccgcaccctgaagcgggggatgcgccggaacctggaccgctaccagctccggcgccaccacctgatcgaggtgctgaaggccaaccacatcatcacggtcgacaccaagctcgccgaggacggcaagaacaccacccacgccacgtacgccgtgcgggcgctggccgccaccgccgagatccccctggaggcgttcgcccgcgtgctcctggccatcaacaagaagcggggctacaagtccagccgcaaggccaagaacgaggacgaggggcagctgatcgacggcatggccgtcgcgaagcggctctacgaggagaacctgacccccgggcagctgtcctacctcctgctgaaggagggcaagaagtacctccccgacttctaccgcagcgacctgaacgccgagctggacaaggtgtggtccttccagaagcagttctacccggagatcctcaccgaggagttcaagaagcacctggaggggaagggccagcgggccacgagcgccgccttctggggccagtacgggttcaacaccgcggagaacaagggctcccgcgaggagaagaagctgaaggcctaccagtggcggagcgaggccgtggaccagcagctcaccaaggaggaggtcgcctacgtgatcaccgagatcaacaacgacctgaacaagtccagcgggtacctgggcgccatctccgaccgcagcaaggagctgttcttcaacaagcagacggtgggccagtacctgtaccagcagctgaagcagaacccccacacccggctcaaggggcaggtcttctaccgccaggactacctggacgagttcgagaccatctgggagacccaggcgaagttccaccccgagctgacggccgccctcaaggaggagatccgcgacgtgatcatcttctaccagcggaagctgaagtcccagaagggcctgatcagcttctgcgagttcgagtccaaggagatcgaggtggagaagaacgggctcaagatcaagaagcgcatcggcctgcgggtcgcccccaagagctccccgctgttccaggagttcaagatctggcaggtcctcaacaacctggagttccgcaacaagagcagcaaggaggtgttcgtgcccgacatgaccgccaagcagcagctgttcgacgagctcaacatcaaggggaacctgctggcgtccgaggccatcaagatcctcggctacaagaccaaggactgggaggccaactaccacaccctggagggcaaccggacgaacaagagcctgtacgacgcctacctgaagatcctcgagctggaggggtacgacgaggacctgctcaagctgtccggcagcgacgacatcgacgtgtccaagatcgagaagtccgcgagcgagatcaagcagatggtgcacgccgtcttcgaggtgctggggatcaacagcaccatcctcgacttcgacgccgaggccgacggcaaggccttcgagcagcagaccgcgtaccgcctgtggcacctcctctactccgccgaggacgacaacaagaagtacctgcaggaggacatcttcatctacgggcacgacaacatcggcctgaagaagaagctctgcgagcggttcggcttccgccccgagcacaccaagatcctggtcaacgtggccttcagcggggactacggctccctgagctccaaggccatgcggaagatctaccccttcatcaaggagctcacgtacgacaaggcctgccgcgaggcggggtaccggcacagcgcctccagcctgtccaaggaggagatcgccacccgcccgctgcagaagcggctcggcctgctgaagaagaacgagctccgcagccccgtggtcgagaagatcctgaaccagatggtgaacgtggtcaacgccctgatcgacgacgagaacaagcggcgcaaggcccgggggctctccgacgacttccacttcgacgagatccgcatcgagctggcgcgggagctgaagaagaacgccaaggagcgcgccgagatgaccaccaacatcaacgccgcgaagcagctccacgagaagatcatcaagatcctgcagacgcagttcggcgtgagcaaccccagccgcaacgacatcatccggtacaagctgtacgaggagctcaagaacaacggctacaaggacctgtacaccaacacctacatctcccccgacatcctgttcagcaagcagatcgacatcgaccacatcatcccgcagatgtccctcttcgacgacagcttctccaacaagaccgtggtcttccgcaaggacaaccaggacaaggggaacaagacggcctacgactacatcctgggcaagtacggggagctggccctcgaggagtacatcagccggatcacctccctgttcgagctgggcaagaagaacaaggaggagggcatcaacaaggccaagttccagaagctccagaagcgcctgatcgacatcggggacggcttcatcgagaaggacctgcgggagagccagtacatcgccaagaaggcgaagaacatgctctacgccatctgccgctccgtggtggccaccagcggggagatcaccgcccggctgcgcgaggactgggacctggtcaacgtgatgcaggagatcaacctccccaagttccgggccctgggcctgaccgagatggtggagaagaaggacgggggccagaaggagcgcatcatcgactggacgaagcggaacgaccaccgccaccacgcgatggacgccctcaccatcgccttcacccggcactcccacatccagtacctgaaccacctgaacgcccgcaaggacgaggccagcaagtggcaccccgtcgtgtccaagatcgaggagaaggagaccgacctcgtgtacgacgacctgggcaaccggaagcgccggttcaaggcgcccatgccgaacttccgcgaggtcgtgaaggagcacctggagaacgtgctcatcagccacaaggccaagaacaaggtcgtgacgaagaacaagaacaagatcaagaccgccaagggggagaagatcaagaccgagctgacgccccggggccagctgcacaaggagaccatctacgggcgctaccggtactacgagtccaaggaggagaaggtgggccccaagttcgacgccgagaccatcgggatggtcgtgaacccccagtaccgcaagctcctgctggagcgcctcaccaccaacggcaacgacccgaagaaggcgttcggcgggaagaacacgctgagcaagaaccccctgtacatcgacgaggccaagcaggagctcctgcccgagaagatcctgctccggtggctgaacgacgactactccatccgcaaggacgtgacccccgagaacctgaaggacgtcaagaccatcgagaaggtgctcgacgagggcatcaagaagatcctgctgaagcggctcgtggacttcgggaacgacccgaagaaggccttcagcgacctggacaagaaccccatctggctgaacgaggccaagggcatcaccatcaagcgcgtcacgatcagcggggtgaagaacgccgaggcgctccactacaagaaggaccacttcggcaacgccatcctgaacgagaacggcaagctgatcccctccagcttcgtgtccaccgggaacaaccaccacgtcgccatctaccgggacgccgagggcaacctccaggagcgcgtggtgagcctgttcgacgccgtccagctggtgaacgcgggggaggccgtgatcgaccgggagtacaacaagggcatcgggtggcagttcctcttcaccatgaagcagaacgagatgttcgtcttcccgaacgagaagaccggcttcgaccccaaggagatcgacctgctgaacacggacaaccgcaagctcatctcccccaacctgttccgggtgcagaagatcgccagcaagaactacttcttccgccaccacctggagaccaacgtggaggagcggaaggagctcaaggacatcgtctacaagccccagctgggcctgaacgccatcaaggacgtggtgaaggtccgcatcaaccacctcgggaagatcatctccgtgggcgagtactga

SEQ ID NO: 2173 - RNA, 4281 nt, synthetic construct
  misc_feature 1..4281: note = Cas9 variant
  source 1..4281: mol_type = other RNA
atgccccgcaagaacatcctgggcctcgacctggggaccaccagcatcggcttcgccaagatcatcgaggacgacgactaccagtgctccagcgtggagctgatcggggtccgggtgaacccgctcacgaccgacgagcagaccaacttcgagaagggcaagcccgtgtccgtcaacgccgaccgcaccctgaagcgggggatgcgccggaacctggaccgctaccagctccggcgcgactacctgatcgagatcctgcggacgcaccacatcatcaccgcggacaccaagctcgccgaggacggcaagaacaccacgcacaccacctacgccctgcgcgccctggccgcgaccgccgagatccccctcgaggccttcgtgcgggtgctgctggccatcaacaagaagcgcggctacaagagctcccggaaggcgaagaacgaggacgaggggcagctcatcgacggcatggccatcgcccgccggctgtacgaggagagcctgacgcccgggcagttctcctaccagctcctgaaggagggcaagaagtacctgccggacttctaccgcagcgacctcaacaccgagctgaacaaggtctggaacttccagaagcagttctaccccgagatcctgaccgacgagttcaagcggcacctcgaggggaagggccagcgcgccaccgccgtggcgttctggggccagcacgggttctccatggccgagaacaagggcagccgggaggagaagaagctgcacgcctacaagtggcgctccgaggccgcccacaagcagctgacgaaggaggaggtggcgttcgtcatcaccgagatcaacaacgacctcaacaagagctccgggtacctgggcgccatcagcgaccggtccaaggagctgttcttcaacaagcagaccgtgggccagtacctccaccagcagctgaaggagaacccccacacccgcctgaagggccaggtgttctaccgccaggactacctcgacgagttcgagacgatctgggagatgcaggccaagttctacagcgccctgaccctggagctcaaggaggaggtccgggacgtggtgatcttctaccagcgcaagctgaagtcccagatggggctgatcagcctctgcgagttcgagtccaaggagatcgagatcgagaagaacggggagaaggccaagaagcggatcggcctgcgcgtcgcgcccaagagcagcccgctgttccaggagttcaagatctggcaggtcctcaacaacctggagttccggaacaagaagaccaaggaggtgttcgtgcccgagatggccgccaagcagcagctgttcgacgagctcaacatcaaggggaacctgctggcctccgaggccatcaagatcctcggctacaagaccaaggactgggaggcgaactaccacacgctggagggcaaccgcaccaacaagagcctgtacgacgcctggctgaagatcctcgagctggaggggtacgacgagaacctgctcaagctgtccggcagcgacgacatcgacgtgtccaagatcgagaagcccgccctggagatccggcagatggtgctcgccgtcttcgaggtgctggggatcagcggcgcgatcctggacttcgacgccgaggccgacgggaaggccttcgagcagcagcccgcctaccagctctggcacctcctgtactccgcggaggacgacggcaagaagtacagccaggaggacatcttcacctacggccacgacaacatcgggctgaagaagaagctgtgcgagaagttcggcttccgcccggagcacaccaagatcctggtgaacgtcgtgttctccgacgactacgggaacctcagctccaaggccatgcggcgcatctaccccttcatcaaggagctgacgtacgacaaggcctgcgccgaggccggctaccggcacagcgcggcctccctgaccaaggaggagatcgccgcccgccccctccagaaccggctggacctgctcaagaagaacgagctgcgcagccccgtcgtggagaagatcctgaaccagatggtgaacgtcgtgaacaccctcgtggacgacgagaaccagaaccggaaggcccgcgggctgtccgaggacttccacttcgacgagatccggatcgagctggcgcgcgagctcaagaagaacgccaaggagcgggccgagatgaccacgaacatcaacaccgccaagcagagccacgagaagatcatccgcatcctgcagaccgagttcggcgtcccgaacccctcccgcaacgacatcgtgcggtacaagctgtacgaggagctcaagaacaacggctacaaggacctgtacaccaacacgtacatcagccgcgacatcctgttctccaagcagatcgacgtggaccacatcatcccccagatgagcctcttcgacgacagcttctccaacaagaccgtcgtgttccggaaggacaaccaggacaaggggaacaagaccgcgtacgactacatcctgggcaagtacggggagcaggccctggaggagtacatcagccgcatcacctccctcttcgagctgggcaagaagaacaaggaggagggcatcgggaaggccaagttccagaagctgcagaagcggctcgtggacatcggcgacgggttcatcgagcgcgacctgcgggagagccagtacatcgccaagaaggccaacaacatgctgtacgcgatctgccgctccgtcgtgagcacctccggcgagatcacggcccggctccgcgaggactgggacctggtgaacgtcatgcaggagatcaacctgcccaagttccgggccctcgggctgaccgagatggtggagaagaaggacggcgcccagaaggagcgcatcaccgactggaccaagcggaacgaccaccgccaccacgccatggacgcgctggccatcgccttcacgcggcacagccacatccagtacctcaaccacctgaacgcccgcaaggacgaggccaacaagtggcacccggtggtctccaagatcgaggagaaggagaccgtgctgatctacgacgacctcggcaaccggaagcgcaagttcaaggcgcccatgcccaacttccgggaggtggtcaaggagcacctggagaacgtgctgatcagccacaaggccaagaacaaggtggtcaccaagaacaagaacaagatcaagaccgtgcgcggggagaaggtgaagacggagctcacgccccggggccagctgcacaaggagaccatctacgggcgctaccgctactacgagtccaaggaggagaagatcggcccgaagttcgacgccgagatgatcgggatggtcaccaacccccagtacaagaagctgctcctggagcggctggccgcgaacggcaacgaccccaagaaggccttctggggcaagaacgccctcaacaagaaccccctgtacgtggacgaggcccgccaggagctgctcccggagaagatcctgctgcggtggctcaacgacgactacagcatccgcaaggacgtgacccccgagaacctgaaggacatcaagaccatcgagaagatcctggacaagggggtcaagaagatcctcctgaagcggctggccgacttcggcaacgaccccaagaaggcgttctccgacctcgacaagaacccgatctggcagaacgaggccaagcgcatcgccatcaagcgggtgaccatcagcgggatcaagaacgccgcgcccctgcaccacaagaaggaccacctgggcaacgacatcctcgacgagaaggggaagcagatcccctccagcttcgtgtccaccggcaacaaccaccacgtcgccatctaccgcgacgccgagggcaacctgcaggagcgggtggtgagcctgttcgacgccgtccagctcgtgaacgggggcgagcccgtgatcgacaaggagtacaacaaggggatcggctggcagttcctgttcacgatgaagcagaacgagatgttcgtcttcccggacgagaagaccgggttcaacccccgcgaggtggacctgctcagctccggcaaccggaagctgatcagccccaacctgttccgcgtgcagaagctcgcctccaagaactacttcttccggcaccacctggagaccagcgtcgaggagaagaaggagctgaagaacatcgcctacaagccccagctcggcctgaacgcgctgtccaacatcgtgaaggtgcgcatcaaccacatcggggagatcgtcagcgtgggcgagtactga

SEQ ID NO: 2174 - RNA, 4281 nt, synthetic construct
  misc_feature 1..4281: note = Cas9 variant
  source 1..4281: mol_type = other RNA
atgaagaacatcctgggcctcgacctggggatcaccagcatctccttcgcccacatcgtggaggacgagaacaaggagaagtccgagatcaaggagctgggcgtccgcatcgtgtccctcaccacggacgagcagagcgacttcgagaaggggaagtccatcaccaccaacgccaaccggaccctgaagcacggcgcgcgcctgaacctcgaccggtaccagcagcgccggaagtacctgatcgacctgctccagaaggccaacctgatcacgagctccagcatcctggccgagaacgggaagaacaccacccactccacctggcagctccgcgccaaggccgtgacggagcggatcgagaaggaggagttcgcgcgcgtcctgctggccatcaacaagaagcggggctacaagagctcccgcaaggccaagaccgaggacgagggccaggccatcgacgggatggcgatcgccaagcggctctacgacgagaacctgacccccggccagctgagcctccagctgctgcagcagaacaagaagctcctgccggacttctaccgctccgacctgcagcgggagttcgacctcgtgtggaacttccagaagcagttctaccccgacatcctgaccgacagcttctacaaggagctgcaggggaagggcaaggacgccacgtccaaggccttcagcaagcgctaccacttcgacaccgccgagaacaaggggtccaaggagagcgtgcggctccaggcgtaccagtggcgcgccgaggccatctccaagcagctgagcaaggaggaggtcgcctacgtgctgaccgagatcaacaacaacctcaacaacgccagcggctacctgggcgcgatctccgaccggagcaaggagctgtacttcaaccgccagaccgtggggcagtacctctacgcccagctgcaggagaaccggcacaactccctgaagaacaaggtcttctaccgccaggactacctcgacgagttcgagcggatctgggagacgcaggccagcttccacaaggagctgaccgacgagctgaagaagcagatccgcgacgtggtgatcttctaccagcgcaagctcaagtcccagaagggcctgatcagcttctgcgagttcgagtccaaggagatcgagatcgagaaggacgggaagaccatcaccaagacgatcggcgcccgggtcgtgcccaagagcagccccctgttccaggagttcaagatctggcagatcctcaacaacgtgacctgcaagcgcaagggcatccggaagaagaagtcctccgccaagagcaccgagctggacctgttcaacgagccgtcccagaccatcttcagcctcgacatggagtgcaagcagctgctgttcgacgagctcaacctgaagggggacctgaagtccgacaaggtcctgaagctcctgggctacagcccccaggagtgggagatcaactacaaccagctggaggggaaccgcacgcagaaggcgctctacgaggcctacctgaagatcgtggagatggaggcccacgacgtgaaggacatcctgcagatcaagtccgccaaggacgactggagcctcgacgagagccccctgagcgccagcgagatcaaggagaaggtcaaggacatcttccaggcgctgggcatctgcaccaagatcctctacttcgaccccctgctgccggtgaaggagttcgagaagcaggactcctaccagctctggcacctcctgtacagctacgagtccgacgacagcacctccgggaacgagaccctgtaccggatcctggagaagaagtacgccttcaagcgcgagcacgcccggatcctggccaacgtggcgctccaggacgactacggcagcctgtccacgaaggccatccgcaagatctaccccaacatcaaggagaaccagtacagcaaggcctgcgagctggccggctacaagcactccaagctcagcctgaccaccgaggagctggaggcccgggagctcaagaacatcatccccctgctgaagaagaacgcgctccgcaaccccgtcgtggagaagatcctgaaccagatgatcaacgtggtcaacgccctgatcgagaagaactccgagcgggacgccgaggggaagatcaccaagtacttccacttcgacgagatccgcatcgagctcgcccgggagctgaagaagaacgcccagaagcgctacgagatgacgcagaacatcaacaaggcgaagctggagcaccagaagatcagcgagatcctccagaagaagttcggcatcaagaacccgaccaagtccgacatcatccggtaccgcctgtaccaggagctggagcacaacgggtacaaggagctctacaccaacgcccccatcgcccgggacatgctgttcagcaagaacatcgagatcgagcacatcgtgcccaaggcccgcgtcttcgacgactccttcagcaacaagaccctgacgttccaccggatcaactccaacaagggcgagtacaccgccttcgactacatcaccagcctcaacagcgaggaggagctgaaccagtacctgacccgcgtggagaacgcgtacaagaccaagtccatcagcctcacgaagtacaagaacctgctgaagaaggcctccgagatcggggacggcttcatcaaccgcgacctccgggacacccagtacatcgccaagaaggccaaggagatcctgttccaggtgaccaagaacgtcctgagcacctccggcagcatcacggaccgcctccgggaggactgggggctggtggacgtgatgaaggagctgaacatgcccaagtaccagtccctcggcctgaccgaggtcgaggagcgcaaggaggggaacaaggtgaccgtgatcaagaactggaccaagcggaacgaccaccgccaccacgcgatggacgccctgacggtcgccttcaccaagccgagctacatccagtacctcaaccacctgaacgcccggaaggacgagaacaacaagaactactccgtgatcctggccatcgaggagaaggagaccatcaaggtgcccaccaacaacggcaagaacaagcgcgtcttcatcgagcccatccccaacttccgccaggtggcgaagaagcacctcgaggagatcttcatcagccacaaggccaagaacaaggtggtcacgaagaacgtgaacaagccggccgggaccgacaagcagcagatcaccctgacgccccggggccagctgcacaaggagaccatctacggcaagtaccagtactacgtgaacaaggaggagaaggtcggggtgaagttcgacgagcggaccatcaccaaggtgtccaaccccctctaccgcgaggccctgctgaagcggctccaggccaacgacaacgaccccaagaaggcgttcaccggcaagaacgccctgagcaagaacccgatctacctggacgagacgaagaccaagaccctccccgagaaggtcaacctgacctacctggaggaggacttctccatccgcaaggacatcagccccgacaacttcaaggacctcaagtccatcgagaaggtgatcgaccagggggtgaagcggatcctgatcaagcgcctgcaggactacgacaacgaccccaagaaggccttcgtcgacctcgagaagaacccgatctggctgaacaaggagaagggcatcgccatcaagcgggtgacgatcagcggcgtgtccaacgcccagcccctgcacatcgggaaggaccacctcggcaagaccaccctgaacaaggaggggaacgagatccccgtcgactacgtgagcaccggcaacaaccaccacgtggcgatctaccgcgacaaggaggggaacctgcaggagcagatcgtctccttcttcgaggccgtggtgcggacgcagcagggcctcccgatcatcgacaagacctacaagcaggaggagggctggcagttcctgttcaccatgaagcagaacgagatgttcgtcttccccaacgccaccacggggttcaaccccgccgagatcgacctgctcgaccccaagaacaagaagctgatcagcccgaacctgttccgcgtgcagaagatcgcgaccaaggactacttcttccggcaccacctcgagaccaacgtggagaccgacaacgtcctgaagaacacgacctggaagcgcgagggcctgagcgggctcaaggacatcgtgaaggtgcgcatcaaccacctgggcgacatcgtctccatcggggagtactga

SEQ ID NO: 2175 - RNA, 4281 nt, synthetic construct
  misc_feature 1..4281: note = Cas9 variant
  source 1..4281: mol_type = other RNA
atgaagcacatcctgggcctcgacctggggaccaacagcatcggctgggccctgatcaagcaggacttcgagaacaagcagggggagatcctcggcatggggtcccgcatcatccccatgagccaggacatcctgggcgacttcggcaaggggaactccgtgagccagaccgccgagcggacgaagtaccgctccgtccggcgcctgcgggagcgcttcctcctgcggcgcgagcggctgcaccgcatcctcaacgtgctgggcttcctgccggagcactacgcgagccagatcgacttcaccaagcggttcgggaagttcaaggaggagaccgagcccaagctcgtgtactccaacgagggcttcatcttcaagaagtccttcgaggagatgctgagcgacttcaagacccaccagccccagctgctcgaggacaacaagaagatcccctacgactggacgatctactacctgcgcaagaaggccctgagccggaagatcgagaaggaggagctcgcctggatcctgctgaacttcaaccagaagcgcgggtactaccagctccggggcgaggaggaggaggagaacccgaacaagctgatcgagttctactccctgaagatcgtcgacgtgctcgccgacgagccccagaagggcaagagcgacatctggtactccctgatcctggagaacgggtggatctaccgccggagctccaagacgcccctcttcgactggaaggagaagacccgcgacttcatcgtgaccatcgacctgaacgacgacggcagcgtcaagaccgacaaggaggggaacgagaagcggtccttccgcgcccccggcgagaacgactggaccctggtgaagaagaagaccgagcaggagatcgacagctcccggaagaccgtgggcacgtacatctacgagaccctcctgaagaacccgaagcagaagatcaaggggaagctggtccgcaccatcgagcgcaagttctacaagaccgagctcaagcagatcctggagaagcagaaggagttccaccccgagctgcggcaggacgacctctacagcgactgcgtgcgcgagctgtacaagaacaacgaggcgcaccagctgacgctcagcaagaaggacttcgtgcacctgttcatggaggacatcatcttctaccagcggcccctgggctcccagaagtccagcatcagcaactgcaccctcgagttccgcaagtacaaggacgagaacgggaccgagcacacccagtacctgaaggccatccccaagtccaacccgtactaccaggagttccggatctggcagtggatgtacaacctgaacatctacaagaaggaggacgacacgaacgtcaccaaggacttcctcaacaccaaggccgacttcgagagcctgttcgagttcctgaacaaccgcaaggaggtggaccagaaggccctcctgaagcacttcaagctgaacgacaagacccaccggtggaactacgtggaggacaagaagtacccctgcaacgagacgaagaccatgatcctgtcccgcctcgacaaggtcgagaacatcagcgacgacttcctgacccgggagatggagcagaagatctggcacatcatctactccgtgaacgacaaggtggagtacgagaaggcgctcaagagcttcgccggcaagaacaacctggaggacaactccttcttcgaggccttcaagaagttcccgcccttcaagagcgagtacggggccttctccgagaaggccatcaagaagctgctgcccctcatgcgcatgggcaagttctggaactacaacaacatcagcgagcagtccaagagccggatccagaagatcatcaccggcgagtacgacgagaacatcaaggacaaggtccgcgagaaggcgatccacctgacgaccgagaccgacttccaggggctgcagctctggctggtgcagtacatcgtgtacggccggcactccgaggccgccatgctggggaagtggaacagcgccgacgacctcgaggagttcctgaaggagttcaagcagcactccctgcgcaaccccatcgtcgagcaggtcatcaccgagacgctccgggtggtgaaggacatctggcagaagtacggcaacggggccaaggacttcttccgcgagatccacatcgagctgggccgggagatgaagctgcccgcggaggagcgcgagcggctcacccgccagatcagcgagaacgagaacaccaacttccgcatcaaggccctgctggccgagatgatggacgacaacagcgtggagaacgtccggcccttctccccgatgcagcaggagatcctcaagatctacgaggagggcgtgctgaacagcgacatcgagatcgaggacgacatcctgaagatctccaagaccgcccagcccagctccagcgacctcaagcgctacaagctgtggctggagcagaagtacaagtccccctacacggggcagatcatccccctcaacaagctgttcaccccggagtacgagatcgagcacatcatcccccagagccggtacttcgacgactccttcaccaacaagatcatctgcgagagcgccgtgaacaagctgaaggacaactacatcggcctcgagttcatcaagaagctcgggggctccatcgtcgagtgcgggaacggcaagagcgtggcgatcctgaagcacgacgcctacgaggacttcatcaagaagcactacgccaacaaccgctccaagcggaacaagctgctgctggaggacatccccgagaagatgatcgagcgccagatgaacgacacccggtacatcagcaagtacatctccggcgtgctcagcaacatcgtccgcgtggaggacgggaccgacgagggcgtgaactccaagaacatcgtccccgggaacggcaagatcacgacccagctgaagcaggactggggcctgaacgacgtgtggaacgacctcatcctgccgcggttcgagcgcatgaaccacctgaccaacagcaccgacttcacggcctggaacgagaaccaccagaagttcctccccaccgtgcccgtcgagttcagcaaggggttctccaagaagcggatcgaccaccgccaccacgccctggacgcgctggtgatcgcctgcgccaccaaggaccacgtgaacctcctgaacaaccagagcgccaagtccgacaccaagcggtacgacctgaagaagaagctcatgaagttcgagaaggtcgcgtacaaccacccgcagacgggcgagcgcatcgagcgggaggcccccaagcagttcctgaagccctgggagaccttcaccatcgacgccaagaaccacctggagaccatcatcgtgagcttcaagcagaacctccgcgtgatcaacaaggccacgaactactacgagaagtacgtcgagaaggaggggaccaaggtgaaggagcgggtggagcagaagggcaccaactgggccatccgcaagcccatgcacaaggagaccgtctccgggaagatcgacctgccgcggatcaaggtgcccaagggcaagatcctgacggcgacccgcaagagcctcgacacctccttcaacctgaagaccatcggcagcatcacggacaccgggatccagaagatcctgaagaactacctccagtacaaggacaacaaccccgagctggccttctcccccgagggcatcgaggacatgaacaagaacatcgagaagttcaacaacgggaaggcccaccagagcatctccaaggtgcgggtcttcgagctgggcagcaagttcccgctcgggcagtccggcaacaagaaggagaagtacgtggaggccgccaagggcaccaacctgttcttcgcgatctaccaggacaagaacgggaagcgcagctacgagaccatccccctgaacgaggtgatcgagcgccagaagcagggcctctccgtcgtggacctgaagggggtggacgacttctacctgagccccaacgacctcgtctacgtgccctccgaggacgagctggagaacatcagcatgatcgacttcaacaagatgtccagcgagcggatctacaaggtggtcagcttcacgggcaaccagatcttcttcgtgcgccaggacatcgccacctccgtggtcaacaaggccgagttcagcaccctgaacaagatggagcgggccatcgacgggaccatgatcaaggagacgtgcgtgaagctccagatcgaccgcctgggcaacatctccaagatctga

SEQ ID NO: 2176 - RNA, 4281 nt, synthetic construct
  misc_feature 1..4281: note = Cas9 variant
  source 1..4281: mol_type = other RNA
atgtacaacatcggcctggacatcgggaccggcagcgtggggtggtgcctcaccgacgagaacggctacctgctgaaggtcaaccgcaaggggaacaacggcaacacgtaccggaactccgcctggggcgtgcgcctcttcgagagcgccgacaccgcggccgactgccggatcaagcgctccacccggcgccggtacaagcgccggcgcacccggatcatcgagctgcgcaagatcatgagcgacatgatcatgcccatcgacccgaacttctacgcccggctggacgaggccttcctctggaacgaggacaagtccgacaaggccaaggcgcccttcctgctgttcaacgacaacgggtacgacgacgtgaagtactacacggactaccccaccatctaccacctccgcaagcacctcctggagaccaaggagaaggccgacccccggttcatctacctggccctgcaccacatgatgaagtaccgcggccacttcctgttcgaggggcagagcttcgaggccatcgacaacatcgaggacaccttcatcgagctcgagcacctggtcaacgtgtacgtgaaggagaaggaggacacggacaacaacgcggagaacaacgccctgtaccaggagatgaagaactacctcgccgacaacaaggtcaagaacaaggacaagaaggagtacatcaccgacaccttcatcaaggccgactacgacaacaagtactccaaggagctggccgcggccgtgctgggctacgagttcaacgtggggatcatcgtcaacgacaacagcctcaccgacgaggacggcaaggccctgaaggccaagttcgccgacgcgaagtacgaggagaaggaggagaagctgtccgacacgctcggcgagcggtactacatcatcgagaccctgaagaagatctacagctggaaggtgctgcactccatcctcggggacaacaagtacctgagctacgccatggtggacaagtacgagaagcactccgagcagctgaaggccctcaagtacctgttccacaagtacaccagccaggacgagtactccgagttcttccaccaggagaagaacaaggagggcaagtacatcgtcaactacgccaactacatcaaggggatcaagcgcctgagcaacgagaccaacaagaagtacaacacgaagcagcagctctaccagtccatcatgaagatcctgggcgagcgggccgcggacgacgaggtgtacaagaagatcctggtggagatggagcaggagaccttcctcgagaagatcaacaacgtcgacaacagcgccatcccgtaccagctgaacctgatggagatggacaagatcctcacccagcagggcgtgtactacaaggagctgcgcgacaacaaggagctgctcctgaagatgctgacctccaagatcccctactacgtggggcccctcaacaacaacagcaacggcaaccggaacttcgcctggatgacgaagaaggacgggaaggagaacgagaaggtctacccctggaacgtgaaggacgtggtcgacatcgacgtgaccgccgaggacttcatcacccgcatgaccaactactgcacgtacctgccgaacgagaaggtgctgcccaaggagagcctcctgtaccagcgctacatgctgctggaggagctctcccagatccggatcgacggccgcaagctgagcaaggaggaccggaaggccatcatcaacgacctgttcatcgggaagggccgcgtcaaggtgtccgacaaggacttcaaggagtacctcaacaaggtcaactacgtgaaggtgaacggcaaggggtacgacgtcaccggctaccagagcgacgacgggttcgcgtgcgccctgtccagctacaacaagttccggcgcatcctgggccacatcgacgagcagaacgagaagatgatcgaggacatcatctactggatcaccgtgttcgaggacaaggacatcgtgaagcggaagatcaacaagcagtacgccgaccgcctctccgccgagcagctgaagaagatcctgaagctcaagttcaaggggtggggccggtacagctccaagctgctgaacggcatcaagggggacatgggcaccacgatcatcgagatgctcgaggacgcggacgagcgcttcgcctactgcgactactgccccaacttcatgcagatcatcaacaaggacgagaagatcaagcagatcatcgacgacaaccggccccgctacgacgggaccaaggacctgctggacgtcatccaggacatgcacaccagcccggccaaccggcgcggcatctggcagaccatgaaggccatcgaggagatcatcgagtacatgggggagaagccccagcagatctacatcgagttcgcccgggaggacgaccccaaggcgaagaacaagcgcgccgactcccggaagcgcgccatcgacaaggccctcaagaagctgaaggaggacgtggtggacgagtacaacgagaaggtctacaaggagctgaagcagtacgagaagcggctcgacgaggagaaggtgtacctgtacttcatgcagaacggcaaggacctgtacttccccgacaaggagctcaacctggacgagctggagaagctcgagatcgaccacatcatcccgtacagcctgtccgacgacgacagcctggacaacaaggccctcgtgctgaagggcaacaaccagaacaaggggaacaagatcgtcaaggaggcgttcccccagctgttctccaacagcggcacggtgaactactggaagaacctcaagaaggccgggctgatctccgagaagaagtacaacaacctgcagaagaacaacgtggacgacatcctcaccaagggcttcatcaaccgccagctggtcgagacccgccagatcgtcaagagcgtggccaacctgatcctcgactactacaacgagcagatcgacgtgatcgaggtgaaggcctccctgagcaccagcgtgcggaagatgctgacgtacgagaagaaggacaacaacggcttctggatcgagaacaaggacaactgcatgttctacaagaaccgcgacatgaacgactaccaccacgcccacgacgcgtacctcgccaacatcatcgggctgtacatccagaagaactacccccggctgcagaaggagctcaactactcccagtaccgccggatctggcgcaagtactacgagaacaccaagaacaacaacggcgtcaactggttcgccaccctggggaagttcagctccaacaacgaggaggccgactggtacggccaggacatcatcgcgtacatgcggaagatcttctgctaccgcgacgtgctgatcagcaagaaggtggaggagaacaccggggccttctactccgagaccaagtacccccgggaggacaaggccggcagcaagctcgtcccgctgaagcagggcaacaacatgcgcggggccaacaacctgaaggagctcgacgcccggaagtacggcgggtacaagggcggggagaaggcgtacttcgtgctggtgaagtactgcatcgagaaggccctgaagaagaaggtcaagaaggagtaccacatggagttcgtggagatccccgtgtacatcgcccgcggcatcaagaacaaggacatcaacctctacgactacgtctgcgacatcctgaacgaggccaacaagaactccgtggccgacgtggagatcctgcggaacaaggtccccaagtaccagatgatcatcggcgagaacggggaggagtactacctcgtgagcgcgacggaggtgatcaactccaagcagttcgtcctgggcggggccaaccagcagtacaaccgcctgctcaactacatcaagtacggcaagaacgacaagtggcagtacatccagaccgagctgctggacgagcagctcatcgggctgtacaacctgctcatcgccaagatcaaggacgagtacaagggcttcagcaaggaggccgtgcggatccaggagaacaactccttcgacaagctggacgtgaaggacaagaaggagttcatcgccgagatgatcaagctggtccagcccgacagcgactacccgtacctcggcaagtacgcgaccgggctgtccaaccgcatgggccggaagaccggggagaaggtgggcaagaagatcacgctggtggacaagagcgtcaccgggctctacgagcgccggaccaccttcgagctggaggacgactccagcacgaagtcctgctga

SEQ ID NO: 2177 - RNA, 4281 nt, synthetic construct
  misc_feature 1..4281: note = Cas9 variant
  source 1..4281: mol_type = other RNA
atgaagaacatcctgggcctcgacctggggaccaccagcatcggcttcgcccacatcgtggaggacgagaacaaggagaagtccgagatcaaggagctgggggtccgcatcgtgagcctcacgaccgacgagcagtccgacttcgagaagggcaagagcatcaccaccaacgccaaccggacgctgaagcacggggcgcgcctgaacctcgaccggtaccagcagcgccggaagtacctgatcgacctgctccagaaggccaacctgatcaccccctccagcatcctggccgagaacggcaagaacaccacccactccacgtggcagctccgcgccaaggccgtgaccgagcggatcgagaaggaggagttcgcgcgcatcctgctggccatcaacaagaagcggggctacaagagctcccgcaaggccaagaccgaggacgaggggcaggccatcgacggcatggcgatcgccaagcggctctacgacgagaacctgaccccggggcagctgagcctccagctgctgcagcagaacaagaagctcctgcccgacttctaccgctccgacctgcagaaggagttcgacctcgtctggaacttccagaagcagttctaccccgacatcctgacggacatcttctacaaggagctgcagggcaaggggaaggacgccaccagcaaggccttctccaagcggtaccacttcgacaccaccgagaacaagggcagcaaggagtccgtgcgcctccaggcctaccagtggcgggcggaggccatcagcaagcagctgtccaaggaggaggtggcctacgtcctgacggagatcaacaacaacctcaacaacgccagcggctacctgggggccatctccgaccgcagcaaggagctgtacttcaaccggcagaccgtgggccagtacctctacgcgaagctgcaggagaaccgccacaacagcctgaagaacaaggtgttctaccggcaggactacctcgacgagttcgagcgcatctgggagacccaggcctccttccacaaggagctgaccgacgagctgaagaagcagatccgggacgtcgtgatcttctaccagcgcaagcccaagagccagaaggggctcatctccttctgcgagttcgagagcaaggagatcgagatcgagaaggacggcaagacgatcaccaagaacatcggcgcccgcgtggtcccgaagtccagccccctgttccaggagttcaagatctggcagatcctgaacaacgtgatctgcaagcggaaggggatccgcaagaagaagatctccgccaagaccacccagctcgacctgctgaacgagagctcccagacgatcttcagcctcgacatggagtgcaagcagctgctgttcgacgagctcaacctgaagggcgacctgaagtccgacaaggtgctgaagctcctggggtacagcccccaggagtgggagatcaactacaaccagctggagggcaaccggacccagaaggccctctacgaggcgtacctgaagatcgtcgagatggaggcccacgacgtgaaggacatcctgcagatcaagtccgccaaggacgactggagcctcgacgagagccccctgtccgcctccgagatccgcgagaaggtgaaggccatcttccagaccctggggatctgcaccaagatcctctacttcgacccgctgctgcccgtcaaggagttcgaggagcaggacagctaccagctctggcacctcctgtactcctacgagagcgacgacagcacgtccggcaacgagaccctctaccggatcctggagaagaagtacgcgttcaagcgcgagcacgcccggatcctggccaacgtggccctccaggacgactacggcagcctgtccaccaaggcgatccgcaagatctaccccaacatcaaggagaaccagtacagcaccgcctgcgagaaggccgggtacaagcactccaagctgagcctcacgaccgaggagctggaggcccgggagctgaagaacatcatccccctcctgaagaagaacgccctgcgcaacccggtggtcgagaagatcctcaaccagatgatcaacgtggtgaacgcgctgatcgagaagaactccgagcgggacgccgagggcaagatcaccaagtacttccacttcgacgagatccgcatcgagctggcccgggagctcaagaagaacgcccagaagcgctacgagatgacccagaacatcaacaaggccaagctggagcaccagaagatcagcgagatcctgcagaaggagttcgggatcaagaaccccacgaagtccgacatcatccggtaccgcctctaccaggagctggagcacaacggctacaaggagctgtacaccaacgcgcccatcgcccgggacatgctgttcagcaagaacatcgagatcgagcacatcgtccccaaggcccgcgtgttcgacgactccttcagcaacaagaccctgaccttccaccggatcaactccgacaagggggagtacaccgccttcgactacatcacgagcctgaactccgaggaggagctcaaccagtacctgacccgcgtcgagaacgcctacaagaccaagagcatctccccgaccaagtacaagaacctgctcaagaaggcgagcgagatcggcgacgacttcatcaaccgcgacctgcgggacacgcagtacatcgccaagaaggccaaggagatcctgttccaggtgaccaagaacgtgctcagcacctccggcagcatcaccgaccgcctgcgggaggactgggggctggtcgacgtgatgaaggagctcaacatgcccaagtaccagtccctgggcctgacggaggtggaggagcgcaaggacgggaacaaggtcaccgtgatcaagaactggaccaagcggaacgaccaccgccaccacgccatggacgcgctcaccgtggccttcacgaagcccagctacatccagtacctgaaccacctgaacgcccggaaggacgagaacaacaagaactactccgtcatcctcgccatcgaggagaaggagaccatcaaggtgcccaccaacaacggcaagaacaagcgcgtgttcatcgagccgatccccaacttccggcaggtcgccaagaagcacctggaggagatcttcatcagccacaaggcgaagaacaaggtggtgaccaagaacacgaacaagcccgccgggaccgacaagcagcagatcaccctgacgccccgcggccagctccacaaggagaccatctacggcaagtaccagtactacatcaacaaggaggagaagatcggggtcaagttcgacgagcggaccatcgccaaggtgtccaacccggtgtaccgcgaggccctgctgaagcggctccaggccaacgacaacgaccccaagaaggcgttcgccggcaagaacgccctgagcaagaaccccatctacctggacgagtccaagaccaagaccctccccgagaaggtcaacctgacgtacctggaggaggacttcagcatccgcaaggacatctccccggacaacttcaaggacctcaagagcatcgagaaggtgatcgaccagggggtgaagcggatcctgatcaagcgcctgcaggcctacgacaacgaccccaagaaggccttcgtcgacctcgagaagaaccccatctggctgaacaaggagaagggcatcgcgatcaagcgggtgaccatctccggcgtgaacaacgcccagccgctgcacatcgggaaggaccacctcggcaagaccaccctgaacaaggaggggaaggagatccccgtcgactacgtgagcacgggcaacaaccaccacgtggccatctaccgcgacaaggaggggaacctgcaggagcagatcgtctccttcttcgacgccgtggtgcgggcgcagcagggcatccccatcatcgacaagacctacaagcaggccgagggctggcagttcctcttcaccatgaagcagaacgagatgttcgtcttccccaacgccaccacggggttcaacccggccgagatcgacctgctggaccccaagaacaagaagctcatcagccccaacctgttccgcgtgcagaagatcgccaccaaggactacttcttccggcaccacctggagaccaacgtggagaccgacaacatcctcaagaacgtcacgtggaagcgcgagggcctgtccgggctgaaggacatcgtgaaggtgcgcatcaaccacctcggcgacatcgtcagcatcggggagtactga

SEQ ID NO: 2178 - RNA, 4281 nt, synthetic construct
  misc_feature 1..4281: note = Cas9 variant
  source 1..4281: mol_type = other RNA
atgaagaacatcctgggcctcgacctggggaccaccagcatcggcttcacgcacatcgtggaggacgagaacaaggagaagtccgagatcaaggagctgggggtccgcatcgtgagcctcaccaccgacgagcagtccgacttcgagaagggcaagagcatctccaccaacgccaaccggacgctgaagcacggggcccgcctgaacctcgaccggtaccagcagcgccggaagttcctgatcgacctgctccagaaggcgaacctgatcaccagctccagcatcctggccgagaacggcaagaacaccacccactccacgtggcagctccgcgccaaggccgtgaccgagcggatcgagaaggaggagttcgcccgcgtcctgctggcgatcaacaagaagcggggctacaagagctcccgcaaggccaagaccgaggacgaggggcaggccatcgacggcatggccatcgcgaagcggctctacgacgagaacctgacccccgggcagctgagcctccagctgctgcagcagaacaagaagctcctgccggacttctaccgctccgacctgcagaaggagttcgacctcgtgtggaacttccagaagcagttctaccccgacatcctgacggacagcttctacaaggagctgcagggcaaggggaaggacgccacctccaaggccttcagcaagcggtaccacttcgacaccgccgagaacaagggctcccgcgagagcgtgcggctccaggcctaccagtggcgcgcggaggccatctccaagcagctgagcaaggaggaggtcgcctacgtgctgaccgagatcaacaacaacctcaacaacgccagcggctacctgggggccatctccgaccggagcaaggagctgtacttcaaccgccagacggtgggccagtacctctacgcgcagctgcaggagaacaagcacaactccctgaagaacaaggtcttctaccggcaggactacctcgacgagttcgagcgcatctgggagacccaggccagcttccacaaggagctgaccgaggagctgaagaagcagatccgggacgtggtgatcttctaccagcgcaagctcaagtcccagaaggggctgatcagcttctgcgagttcgagtccaaggagatcgagatcgagaaggacggcaagaccatcacgaagtccatcggcgcccgcgtcgtgcccaagtccagccccctgttccaggagttcaagatctggcagatcctcaacaacgtgacctgcaagcggaaggggatccgcaagaagaagtccagcgccaagtccaccgagctggacctgttcaacgagccgagccagaccatcttctccctcgacatggagtgcaagcagctgctgttcgaggagctcaacctgaagggcgacctgaagtccgacaaggtcctgaagctcctggggtacagcccccaggagtgggagatcaactacaaccagctggagggcaaccggacgcagaaggccctctacgaggcgtacctgaagatcgtggagatggaggcccacgacgtgaaggacatcctgcagatcaagagcaccaaggacgactgggccctcgaggagagccccctgagcgccagcgagatccgcgagcgggtcaaggccatcttccagaccctggggatctgcaccaagatcctctacttcgaccccctgctgccggtgaaggagttcgaggagcaggactcctaccagctctggcacctcctgtacagctacgagtccgacgacagcacgtccggcaacgagaccctgtaccgcatcctggagaagaagtacgcgttcaagcgggagcacgccaccatcctggccaacgtgaccctccaggacgactacggcagcctgtccacgaaggccatccgcaagatctacccctacatcaaggagaaccagtacagcaccgcgtgcgagaaggccgggtacaagcactccaagctgagcctcaccaccgaggagctggaggcccgggagctgaagaacatcatccccctcctgaagaagaacgccctgcgcaaccccgtcgtggagaagatcctcaaccagatgatcaacgtggtcaacgccctgatcgagaagaactccgagcgggacgcggagggcaagatcacgaagtacttccacttcgacgagatccgcatcgagctggcccgggagctcaagaagaacgcccaggagcgctacgagatgacccagaacatcaacaaggccaagctggagcaccagaagatcagcgggatcctgcagaaggagttcggcatcaagaacccgaccaagtccgacatcacccggtaccgcctctaccaggagctggcccacaacgggtacaacgacctgtacaccaacacgtacatccccaaggagctcctgttcagcaagaacatcgacatcgagcacatcgtgtccaaggcgcgggtcttcgacgacagcttctccaacaagaccctggccttccgcgagttcaacatcaagaagggcgagagcaccgccttcgactacatcaccagcctcaacaacgaggaggagctgaaccagtacctgaaccgggtggagaacgcctacaagacgaagaacatctcccccgccaagtacaagaacctcctgaagaaggcgagcgagatcggcgacgggttcatcaaccgcgacctgcgcgacacccagtacatcgccaagaaggccaaggagatcctcttccaggtgaccaagaacgtcctgtccaccagcggctccatcacggaccggctgcgcgaggactgggggctcgtggacgtgatgaaggagctgaacatgcccaagtaccagagcctgggcctcaccgaggtcgaggagcggaaggaggggaacaaggtgaccgtgatcaagaactggaccaagcgcaacgaccaccggcaccacgccatggacgcgctgacggtcgccttcaccaagccgtcctacatccagtacctgaaccacctcaacgcccgcaaggacaagaacaacaagaactacagcgtgatcctggccatcgaggagaaggagaccatcaaggtgcccaccaacaacggcaagaacaagcgggtcttcatcgagcccatccccaacttccgccaggtggccaagaagcacctggaggagatcttcatctcccacaaggcgaagaacaaggtggtcacgaagaacaccaacaagccggccggcaccgacaagcagcagatcaccctcacgccccgggggcagctgcacaaggagaccgtgtacggcaagtaccagtactacgtgaacaaggaggagaagatcggggtcaagttcgacaaggagaccatcgccaaggtgagcaaccccgtgtaccgcgaggccctgctcaagcggctgcaggccaacgacaacgaccccaagaaggcgttcgccggcaagaacgccctgtccaagaacccgatctacctcgacgaggccaagaccaagacgctgaccgagaaggtcaacctgacctacctcgaggaggacttcagcatccgcaaggacatctcccccgacaacttcaaggacctcaagagcatcgagaaggtgatcgaccagggcgtgaagcggatcctgatcaagcgcctgcaggactacgacaacgaccccaagaaggccttcgtcgacctggagaagaaccccatctggctgaacaaggagaaggggatcgcgatcaagcgggtgaccatctccggcgtgaacaacgcccagccgctccacatcgggaaggaccacctgggcaagacgaccctgaacaaggaggggaaggagatccccgtcgactacgtgagcaccggcaacaaccaccacgtggccatctaccgcgacaaggagggcaacctccaggagcagatcgtctccttcttcgaggccgtggtgggggcgcagcagggcctgcccatcgtcgacaagacctacaagcaggccgaggggtggcagttcctgttcacgatgaagcagaacgagatgttcgtgttcccgaacgaggccaccggcttcaaccccgccgagatcgacctcctggaccccaagaacaagaagcagatcagccccaacctgttccgggtgcagaagatcgccaccaaggactacttcttccgccaccacctcgagaccaacgtcgacacggacaacgtgctgaagaacaccacctggaagcgggaggggctgtccggcctcaaggacatcgtgaaggtccgcatcaaccacctgggcgacatcgtgagcatcggggagtactga

SEQ ID NO: 2179 - RNA, 4284 nt, synthetic construct
  misc_feature 1..4284: note = Cas9 variant
  source 1..4284: mol_type = other RNA
atgaagaagatcctgggcctcgacctggggaccagctccatcggctgggccctggtgaacgaggccgagaccagcgaggagaagtccagcatcatcaagctcggggtccgcgtgaaccccctgacggtggacgagctgcagaacttcgagaagggcaagtccatcaccaccaacgcggaccggaccgccgggcgcagcatgcggcgcaacctccagcggtacaagctgcgccgggagaacctgatcgaggtcctcaaggagtacaacttcatcacggacgagatgatcctgtccgagaacggcaaccgcaccaccttcgagacctaccggctgcgcgccaaggccgccgtggaggagatcagcctcgagcagttcgcgcgggtgctgctgatgatcaacaagaagcgcggctacaagtccagccggaaggccaagggggccgagaacggcacgctcatcgacgggatggaggtcgccaagaagatgtacgacgagggcatcaccccgggggagctgtgcctgcagctcctgaccgcgggcaagcgctacttccccgacttctaccggtccgacctgcaggccgagttcgaccgcatctggaacttccagaagcagttctaccccgacagcctcatcgacaaggtgaaggacgaggtgcggggcaagaacaagtcccagacctgggccatcctggccaagtacttcgtctggaaggaggtggagaacagctggaacgaggaggaggcccagacgcgccgggtggagaaggagtaccgcctggtcgggatcaagcggggcgtgaagcgcgaggagctcaagctggagaacttccagtggcgcgtgaaggcgctgtccgagcggatgaaccccgaggagctcgccatcgtcctgcaggagatcaacgagcagatcagcaactccagcgggtacctgggcgccatctccgaccgcagcaaggagctctacttcaaccggcagaccgtgggccagtaccagatggccgtgctggacaacaacccgaacatcgggctgcgcaacatggtcttctaccggcaggactacctcgacgagttcaacaccatctgggagaagcaggccgagttccacaaggagctgaccgaggacctgaagaaggagatccgcgacatcgtgatcttctaccagcggcgcctcaagagccagaagggcctgatcaacatctgcgagttcgagcggcgccagatcgaggtggagatcgacgggaagaagaagatcaagacgatcggctcccgggtcatcccccgcagcagccccctgttccaggagttcaagatctggcagaccctcaacgacatcgaggtgtccgtgctgggggtcaagaacaagcggaagaagcaggacgacaactccaccaccctgctcgacagcgcggagaacatcgactccctgaagctgaacgtgagccgccccctcgacgccgacgagaagtccctgctggccaaggagctgttcatccgggacaagctgaccaagagcgacgtcctgaagctcctcttcaacaacccgcagaacctgaacctgaacttcaagaacatcgacggcaaccgcaccggctccgccctctaccaggccttcagcaagatcctggagatctccgggcacgagagcatcaacttcaagaagtccgcggacgagatcgtggagcaggtcaagaccatcttcagcgccctgggctggaacaccgaggtgctctgcttcgactccgagaaggagctggacaagcagccctacttcaagctgtggcacctcctgtacagcttcgagggggactccacgcccaccggcgacgggaacctgatccagaagatcgccgacctctgcggcttcgagaaggactacgccagcatcctggccaacatcaccttccaggaggactacggcagcctgtccaccaaggcgatccggaagatcctcccccacctgaaggacgggaaccagtacgacgtggcctgcgagtacgccggctacaagcacagcaagtccagcctgaagaaggaggagatcaagaacaaggtgctcaaggacaagctggagctgctcccgaagaactccctgcgcaaccccgtcgtggagaagatcctgaaccagatggtgaacgtcatcaacgccatcatcacgacctacgggaagcccgacgagatccggatcgagctcgcgcgcgagctgaagaagaacgccaaggagcgcgaggagctgaccaagagcatcgtggacaccacgaagacccacgagggcatccgggccatcctccagaacgacttcgggatgtcccacgtgagccgcaacgccatcatccggtacaagctgtacgaggagctgaaggacaacggctacaagaccctctactccaacacctacatccccaaggagaagctgttcagcaaggacttcgacatcgagcacatcatcccgcaggcccgcctgttcgacgactccttcagcaacaagacgctcgaggtcaagtccatcaacatcgagaagggcagcaagaccgcgtacgacttcgtggaggagaagtacggggagcagggcctgcaggagtacctgaaccggtgcgaggtcctcttccgcgacaagaagaccaagctgcggaagctgaagatgcaggagtccgagatccccgaggggttcatcgaccgcgacctccggaacacccagtacatcgccaagaaggccctgagcatgctgaacgagatctgccgccgggtggtggccaccacgggcgccatcaccgacgagctccgcgaggactggcagctggtggacgtcatgaaggagctgaactgggagaagtacaaggtgctcggcctggtggagtacttcgaggacaacgacgggcggctgatcggccgcatcaaggactggaccaagcggaacgaccaccgccaccacgcgatggacgccctcaccgtcgccttcacgaaggacgtgttcatccagtacttcaacaacaagaacgcctccctgaagcccgacaccaacgaggccgcgatccggaacaagtacttccagaacgggaaggccatcccgcccatgagcctggacgagttccgcgccgaggccaagaagcacctcaacgacaccctgatcagcatcaagaccaagaacaaggtggtcacgatcaacctgaaccggaccaagaagaagaacggcatcaacaagaagcagcagcagacgccccgcgggcagctccacctggagaccgtgtacggctcccacaagcagtacgtggtcaaggaggagaaggtgaacgcgagcttcgacgccgccaagatcgccacggtgaacaagcccgcctaccgggacgcgctgctccgccgcctgcaggagaacggcaacgactccaagaaggccttcaccgggaagaacagcctggacaagcagcccgtctggctcgacgccaagcagaacgagtgcgtgccggagaaggtgaagaccgtcatgctggagaccgtgtacacggtgcggaagcccatcgacgagaagctgaacgtcgacaaggtggtggacgcccgcatccggaagctcctgcaggaccgcatcaaggagtacggcaacgccaagtccgcgttcgccaacctggacgagaaccccatctggctcaacaaggagaaggggatcaccatcaagcgggtcagcgtgtccggcatcagcaaggcccagtccctgcacgagaagaaggacaaggacgggaacttcatcctggacaaggacagccgccggatccccgtggacttcgtcaacaccggcaacaaccaccacgtggccatctaccgcaagccggtgctcgacaagaagggccaggccgtcttcgacgagaacggggagctgaagttcgagctggaggaggtggtggtctccttcttcgacgcggtgacccgggtgaacctcagccagcccatcatcgacaaggactacaagcgctccgagggctggaagttcctgttcagcatgaagcagaacgagtacttcgtcttccccaacgagaagacggggttcgacccgaaggagatcgacctgctcaaccccgagaactacgccctgatctcccccaacctgttccgggtgcagaagatcgccagcaaggactacgtcttccgccaccacctcgagaccgtggtggccgaccggaaggagctgcaggagatcacctggaagcgcatctccagcctgtccatcctcaaccggatcatcaaggtccgcgtgaaccacatcggccagatcgtgatgatcggggagtactga

SEQ ID NO: 2180 - RNA, 4284 nt, synthetic construct
  misc_feature 1..4284: note = Cas9 variant
  source 1..4284: mol_type = other RNA
atggccaagcccaaggactacaccatcggcctggacatcgggaccaacagcgtgggctgggtcgtgacggacgaccagaacaacatcctccgcatcaaggggaagaaggccatcggcgcgcggctgttcgccgaggggaaggtggccgccgagcgccggtccttccgcaccacccggcgccggctgagccgccggcgctggcggatcaagctcctggaggagctgttcgacaaggagatcgccaaggtcgacccgtccttcttcgcgcgcctccacgagagctggatctcccccaaggacaagcggaagcgctacagcgccatcgtgttcccctcccccgaggaggacaagaagttccacgagagctacccgaccatctaccacctccgggacaagctgatgaaggacgaccagaagcacgacatccgcgagatctacatcgccgtgcaccagatgatcaaggcccggggcaacttcctccacgacgagtccgtcgagacgtaccgcagcggcatgtccagcctcgggggccggtccgagcgcaccatcctgagcgtgcagaccctggaggagctgaacgacctgttcgcggagaacgaggggaccgaggaggccaagctcaacgtggcctccgccgagcagatcaacgacatcctgacgggcgggcacctgaacgccgacagccagaaggagatcggcaacctcctgctgccctccagcttcccctccttcgacgacaaggcgaaggagaagcaggtcaagaagctcatcaagaacgtggccaccaacatcagcaaggcctggctgggctacaaggccgacttcagcaccatcctgaacctcgccaacgtggacaaggaccagaagaagatcttcgcgttcgccctgcagggcggggacgaggaggacaaggtccaggagctggagtccctcctggagcagagccagaccgacatcgtggaccggctgatcgagatccgccacgccatcgtgctctccgagatcgtccccgtggggatgacgctgagcgaggccatgatcgacaagtacgaccagcacaaggaggacctgatcaccctcaaggccgtgatccgcaacaccaaggacaagaagaaggcggccaagctgcaggccatctacgacctgtacgtcaacaaccggcacgccgacctcgccaaggcgatgaagctgaccggcatcaagaagcgctccgagctgctcgacccggaggagctgaagaaggccatcagctccctgctcgacgacagccccgaggccgtggagatcaagcagatgctggaggagaagacgttcctgcccctccagcggtccaacaacaacggcgtgatccccaaccagctgcaccaggtcgagctggacgagatcatcaagaagcagagcaagtactacccgttcctcgccgagaagaaccccgacgagtccgaggaggcgcagaagaaggcccccaccaagctggacgccctgctgaccttccgcgtgccctactacgtggggccgatgatcaccaaggaggagcaggaggcccaggacggccacagcttcgcctggatggtccggcgcgacccccaggaccacgaggcgatcacgccctggaacttcgagaagaaggtggacaagatggcctccgccacccagttcatcaagcggatgaccaccaaggacacgtacctcctgggggaggacgtcctgcccgccagctccctcaagtaccagctgttcaccgtgctgaacgagctcaacaacctgcgcgtgaacggcaagaagctgaccagcgacgagaaggagcaggtcatcgaggggctgttcaagaagcagaagaccgtgaaggccgacaagttcgtgaagtactggcaggcgaagcacatcggcgccgacatcaaggtcaagggcctgtccgacccgagcaagttcaactccacgatgagcacctacatcgacttcaagaagatcttcggggaccagctgaacgacgtgaaccggcagaacgacttcgagaagatcatcgagtacagcaccatcttcgaggaccgcaagatcctcgaggacaagctgcgggccgacttcgcctggctgtccgaggagcagatcaagcagctctgccgcctgcggctgcagggctgggggcgcctcagcgacaagctgctgacccggctcacggacgccgacggccagaacgtgctggagcgcctgtggaactccaacgacaacttcgtccagatcgtgagcgaccccaacatcaaggcgaagatcgagcaggagaaccagaagctcctgcgggacgggcagtccgacgacgccgtggagagcatcctggacgacgcctacaccagcccccagaacaagaaggccatccgccaggtcatgcgggtggtgcacgacatcgtcaaggcgtgcgacggcaacgtgcccgccaagttcgccatcgagttcgcccgcagccaggaggacgacccgaagcgcaccaccgcccgggtgaaccagatgcagaagatctacgaccagatctccgacgaggtcgtgagccagggcgtgaaggagcagctctccgggatgaagtccctgaaggaccgctactacctgtacttcatgcagggcgggcgggacgcgtacacgggcgccaagctcaacatcgaccgcctgtccgactacgacatcgaccacatcatgccccagagcttcgtcaaggacgactccctggacaaccgggtgctcgtggcccgcgccgtcaacaaccagaagtccgacaaggtgcccgccctgctgttcgggaacaaggtggtcgcggacctcggcatcaccgtgcgggagatgtgggacaagtggcagaagctgggcatgatcagcaagcgcaagctgagcaacctcctgaccgaccccgacgccctgaccgagtaccgggcccaggggttcatccgccggcagctcgtggagaccagccaggtcatcaagctgacggccaccatcctgcagtccgagttcccggacagcaagatcatcgaggtgcccgccaagtacaactccatcgtgcgcaagcagttcgacctctacaagagccgggaggtcaacgactaccaccacgcgatcgacgcctacctgtccaccatcgtgggcaactacctgtaccaggtgtaccccaacctccgccggatgttcgtctacggggagttcaagaagttcagctccaacgccgaggagagcgcctacgacgtggtgcgccgggtcaagtccatgaacttcctggacgacctgctccgcggcacccacggcgacaacatctactgccggagcacgggggagatcgtgttcaaccgcaacgacatcatctccaagctgaagcaggcgtacagcttcaagcagatgctggtgacccaggaggtcttcaccaagaagtccgccctcttcgaccagaccgtgtacccgagccccgagcgggactccaagaagcgcagcggcctgatcccccgcaagaaggggatggacacggagatctacggcgggtactccggcaacaaggacgcctacttcgtgctggccgaggccgtcaaggagaagggccacaccctccagatcgtgggggtgcccatccgggcgctgaacaccctgaagaacagcgccaactactccgagaagctcctggagatcatcaagccgcaggtcatgttcaacaaggacaccggcaagcccatcaaggggatcaaggacgtgaagatcctgatggacaagatcccctgccgccagcccgtgctcgagggcgagagctactacatgctggccagctccaagtaccggtacagcctgaagcagatctccctcagccagatgtccatgaagtacatcctggactacatcgacgacccgaacttcaacaagcacgagatgatcaacatcgaccagcaggacgagaaggagtgcctgctcagcgtctacgacgagatcctggagaagatggacaagtacctgcccctcttcgacatccgctccttccggaagaagctgcacgacgggcgcgacgccttcatcgccctgcccgtggcgagcgaggagaagaagcccggcaaggtcgacgtgatccggaaggtgctcaagggcctgcacgccaacgccgacatcacgaacctggccgagctcgggttcggcaccgccgcgctgggggccctggtctccaccggcgggatcaagatcagcgacgacgccgtgttcatctaccagtccccgaccggcctcttcgagcgccgggtgaaggtcagcgacctgctgaagtga

SEQ ID NO: 2181 - RNA, 4287 nt, synthetic construct
  misc_feature 1..4287: note = Cas9 variant
  source 1..4287: mol_type = other RNA
atgaagaagatcctgggcctcgacctggggaccaccagcatcggctccgcctacgtgctggaggccgagaagtccgcggagcagacgaagatcgtctacctcgggacccgcatcatcctgagcagcgccgacgccgagaacttctccaagggcctgagctgctcccccaccaccgaccggacgttcaagcgcagcatgcggcgccggctccagcgctacaagcagcggcgctccagcctgatccagcagttcaagaagatcgggatcatcaccaacaccgagcagatcatccgggagccgatctccgagacccacgagctgctccgcatccggagcaaggccgtgtccgagcgcgtgagcctggaggagttcgcccggatcctgctcacgatcaacaagcgccggggctacaagtccaaccgcaagaccagcaagtccaccgaggaggacggcaagctggtcgacgcgatggccgtgaccaaggagctgatcaagctcaagaagacgcccgggcagtacatgttcgagcggttcaagcgcggcaagtacgccgagatcgacttctaccccttcgacctgatcaacgagctgaagcagatctgggaggtgcaggggcagaagtaccccgacgtcctcaccgaggacctgctgagctccctcctgaagcagaagaccggcaaggccaaggagctgatctacagcaagagcgacctcaacccggcggaggtgcccatcgactaccagaaggggaagaagctgcggaagaccatcctgaacaagtacttcgcctacgagtcccgcagcctcgccgccacgaacatcatccccgtggagcaggtcatcaccgccatcgtggcgatctgcaagcagatcaacaactccagcggctacctgggcgccatcggggaccggtcccgcgtgctgtacgccaacaaccagaccatcggccagtacctctacgagcgcatcaaggccaacccccacgaccggatccgcggggaggtcttctaccggcaggactacctggacgagttcgaccgcatctgggagtgccagcagaactactacccggccatcctgaccaacgaccggaagcagttcatccgcaaccggatcatcttctaccagcgccccctcaagagcaagaagtccgagctggcgttctgcgagttcgagagccgggaggtggagcacaacggcaagaagtacacggagggcctgcacgtggcccccaagtccagccccgtcttccagcacttccgcctctggcagcggctggggcagatcgaggtgtccccgctgcgcaagtggaacaagcagagcaacgagctgttcgagcagcagaacgacaccgaccaggagcggatcctgaacaccgaggccaagcagaagctgttctcctacctcaacctgctggaccacctcaccgacaacgagatcctgaacatcctgggctacagccccgacaagtggaagatcaacttccgcgagatcatcgggaaccggacgaacaactccatgatgaaggccttcttcaacatgaaggagatgaccgacggcgagcagatcaactgggagaagaacctcaccaagatcaccaacgggcagagcctgatctcccccgagcagatcgtggacctgatccgccagttcttcgagcgggagggcatcacgaccagcctgctctacttcgaccccaccaccgacaacttccgcgagcagtcccactacagcctgtggcacctcctctacagctacgaggacgacaactccccgacgggcaccaccagcctgtgcaagaccctggccaagcggtacgggatcccccacgagctctgccccctgctggcgtccctcacgttcgagccccagtacggcagcctgtccaccaaggccatgcgcaagatcctgccgttcatgcaggagaacgggtacgacaaggcctgcgagctcgccggctaccgccacagcgcctggaccaccaaggaggagaacaccgagcggacgctgaagaactccctgcccctcctgcgcaaggggagcctgcggaaccccgtcgtggagaagatcctcaaccagatgacccacgtgatcaacacccacatctccgagtacggcaaccccgacgagatccgcatcgagatggcgcgggacatgcaggccaacagcaagcagcgcaaggccatgaccacggccatcgcggaggccaccaagcggaacacccagttcatcgaggagatccagaaggagttcggcttcaacccgtccaagaacgacctgatcaagtacaagctgtggaaggagctcgcgcccctggggagcaagaccctgtactccaacacgtacatccccaaggaggagctgttcaccgccaagttcgagatcgagcacatcatcccccgcgccctgttctacgacgacagcttctccaacaagaccctggagctcaacagcgtcaacaagctgaagggcaacaagaccgccctggactacatggacacgctctcccaggagcaggccaacgactacatcatccgggtggaggagctgaagaagatcggggccatcacccaggccaagtacaagaagctgctcatccgcgagaaggacctgggcgacgacttcaccaaccgggacctgaccaacacgcgctacatcatccggcacgccgcggacatgctcctccaggtgaccccgagcatcgtccacaccaacgggagcatcaccgccatcctgcgccgggactgggagctcctggacatcctgaaggagctcaacctgcccacgtacgagtccatcgaccgcaagatcagcgaccccaaggagaagctgaccgagtccgtggagcggaaggacggccaggccatcaagatgatcaaggactggagcaagcgcgacgaccaccggcaccacgccatggacgccctcatcaccgcgctgaccacgcgcaagcacgtccagtacctgaacggcaaccgcggggccgaggagaccgacaaggtgcagaagctccagcagctgaaggccctgcggaagcagctcatcggctccgacgggcacttcatcccgcccatgcacgacatccgcgtgcaggccaaggaggcgctgagccgggtcatcatctccaccaaggccaagggcaaggtgaccacgcccaacaccaacatcatctgcagccgcgacaagaccaccggccggaagatctacgtgaagcagacgaccctgacgccccgcggggccctccacaaggagatgcagtacggctgcaaccactactacctggagaagcagatcccgatcgggtccaagctgaccgaggaggagatccggctcgtcagctcccccaagatccgcagcatgctgtccgagcggctgcaggcctacaacaacgaccccaagagcgccttcaccggccgcaactccatggacaagaagcccctcgaggacaagaacaagaagctggtgtacaccgacaagaaggtgaagcagaccatcctggcgaaccggttcgtcaagcgcgaccgggtgaacagcaagctcgacctggacaaggtgatcgacaccgggatcaagcgcatcctggagcggcgcctcaagcagtacggcggcaagtacgagaccgccttctccgacctggagaacaacccgatctggctgaacgaggagaaggggatcgccatcaagagcgtccggatccgcggcaagaacaacacgatcaccatccggcagaccaacacgtgccgcatcaagtacgtggccaacgacaacaaccaccacctcgccgtgtacgcgctgcccgacgggtccatcgaggacgacatcgtcagcttcttcgacgccgtggagcggagccgcaagggcctgcccatcatcgacaagcacaagaaccagtccctcgggtggaagttcctgttcagcgtgaagcagaacgagtacttcctgctcccccagcagggcgagaagatcgacatcgacaccggcgagatctccatgcagaccaccttcagcccgaaggacctgtcccccgagtacatcatgaaccccgacaactacgccgagctggcgccccacatcttccgcgtccagagcatctccaagaccccgcaggggaaccgggacgtgcgcatctacctcttcaagcagcagtacatcagcggctcccagaaggacagcctgcacctgaaggggatcacgcaccggcagatctccagcgccaaggacctcgccggcctggtgaagatccgcgtcaaccacctggggcggatcgtggccgtgggcgagaagtga

SEQ ID NO: 2182 - RNA, 4287 nt, synthetic construct
  misc_feature 1..4287: note = Cas9 variant
  source 1..4287: mol_type = other RNA
atgaagaagatcctgggcctcgacctggggaccgccagcatcggctccgcctacgtgctggaggcggagaagtccgccgaccagaccaagatcgtctacctcgggacgcgcatcatcctgtccagcgccgacgccgagaacttctccaagggcctgagctgctcccccaccaccgaccggaccttcaagcgcagcatgcggcgccggctccagcgctacaagcagcggcgctccagcctgatccagcagttcaagaagatcgggatcatcacgaacaccgagcagatcatccgggagccgatctccgagacccacgagctgctccgcatccggagcaaggccgtgtccgagcgcgtgagcctggaggagttcgcgcggatcctgctcaccatcaacaagcgccggggctacaagtccaaccgcaagacgagcaagtccaccgaggaggacggcaagctggtcgacgccatggccgtgaccaaggagctgatcaagctcaagaagacccccgggcagtacatgttcgagcggttcaagcgcggcaagtacgccgagatcgacttctaccccttcgacctgatcaacgagctgaagcagatctgggaggtgcaggggcagaagtaccccgacgtcctcacggaggacctgctgagctccctcctgaagcagaagaccggcaaggcgaaggagctgatctacagcaagagcgacctcaacccggccgaggtgcccatcgactaccagaaggggaagaagctgcggaagaccatcctgaacaagtacttcgcctacgagtcccgcagcctcgccgtgaccaacatcatccccgtcgagcaggccatcacggcgatcgtggccatctgcaagcagatcaacaactccagcggctacctgggcgccatcggggaccggtcccgcgtgctgtacgccaacaaccagaccatcggccagtacctctacgagcgcatcaaggccaacccccacgaccggatccgcggggaggtcttctaccggcaggactacctggacgagttcgaccgcatctgggagtgccagcagaactactacccggcgatcctgaccaacgaccggaagcagtacatccgcaaccggatcatcttctaccagcgccccctcaagagcaagaagtccgagctggccttctgcgagttcgagagccgggaggtggagcacaacggcaagaagtacaccgagggcctgcacgtggcccccaagtccagccccgtcttccagcacttccgcctctggcagcggctggggcagatcgaggtgtccccgctgcgcaagtgggacaagcagagcaacgagctgttcgagcagcagaacaacgccgaccgggagggcatcctgaacacggaggccaagcagaagctgttctcctacctcaacctgctggaccacctcaccgacaacgagatcctgaacatcctggggtacagccccgacaagtggaagatcaacttccgcgagatcatcggcaaccggaccaacaacctcatgatgaaggcgttcttctccatgaaggagatgaccgacggggagcagatcgactgggagaagaacctgacgaagatcaccaacggccagagcctgatctcccccgagcagatcgtggacctgatccgccagttcttcgagcgggagggcatcaccaccagcctcctgtacttcgaccccgccacggacaacttccgcgagcagtcccactacagcctgtggcacctcctgtacagctacgaggacgacaactccccgaccgggaccaccagcctgtgcaagacgctcgccaagcggtacggcatcccccacgagctgtgccccctgctcgcctccctgaccttcgagcgccagtacgggagcctgtccaccaaggccatgcgcaagctcctgcccttcatgcaggagaagcggtacgacgaggcgtgcgagctggccggctaccgccacagcgcctggatcaccaaggaggagaacgccaagcggacgctcaagaacaagctgccgctgctccgcaaggggtccctgcggaaccccgtcgtggagaagatcctgaaccagatgacccacgtgatcaacacccacatcgcggagtacggcaaccccgacgagatccgcatcgagatggcccgggacatgcaggccaacagcaagcagcgcaaggccatgaccgccgcgatcaccgaggccacgaagcggaacacccagttcatcgaggagatccagaaggagttcggcttcaacccctccaagaacgacctcatcaagtacaagctgtggaaggagctggccccgctcgggaacaagaccctgtacagcaacatctacatccccaaggaggagctgttcaccgccaagttcgagatcgagcacatcatcccccgcgccctcttctacgacgactccttcagcaacaagacgctggagctgaactccgtcaacaagctcaagggcaacaagaccgcgctggactacctggacaccctcgggcaggagaaggccaacgactacatcctgcgggtggaggagctgaagaagatcggcgccatcacccaggccaagtacaagaagctcctgatccgcgagaaggacctgggggacgacttcacgaaccgggacctcaccaacacccgctacatcatccggcacgccgcggacatgctgctccaggtgacccccagcatcgtccacacgaacggctccatcaccgccatcctccgccgggactggggcctgctggacatcctcaaggagctgaacctgccgacctacgagagcatcgaccgcaagatctccgaccccgaggagaagctcacccagagcgtggaccggaaggacgggcaggccatcaagatgatcaaggactggagcaagcgcgacgaccaccggcaccacgccatggacgcgctgatcacggccctgaccacccgcaagcacgtccagtacctcaacggcaactccggggccgaggagaccgacaaggcccagaagctggagcagctgaaggccctccgcaagcagctgatcggcagcgacggccacttcatcccgcccatgcacgacatccgggtgcaggcgaaggaggccctgtcccgcgtgatcatcagcacgaaggtcaaggggaaggtgaccacccccaacaccaacatcatctgctcccgggacaagacgaccggccgcaagatctacgtgcggcagaccaccctcacgccccgcggggccctgcacctggacaccaagtacggcatcaaccggtactaccaggagcgcgaggtcagcatcgggtccaagctcacccaggaggagatccggctggtgagcagcccccacatccagagcatcctgctcgagcgcctgcgggccttcgacaacaacccgaagtccgccttcaccggccgcaacagcgtggacaagaagcccctggaggacaagaacaagaagctcgtctacacggacaagaaggtgaagcagaccatcctggcgaaccggttcgtgaagcgcgaccaggtcaactccaagctgaacctcgacaaggtgatcgacaccggcatcaagcggatcctggaggggcgcctgcagcagtacggcgggaagtacgagaccgccttcagcgacctcgagaacaaccccatctggctgaacgaggagaagggcatcgccatcaagtccgtgcggatccgcgggaagaacaacgccatccccatccaccagacggacacgtgcccgatcgactacgtcgccaacgacaacaaccaccacctggcggtgtacgtgctccccgacggcaccatcgaggacgacatcgtcaccttcttcgacgccgtggagcggagccgccagggcctgcccatcgtggacaagaacaagaaccagtccctggggtggaagttcctcttcagcatcaagcagaacgagtacttcctgctgccccagcaggccgagaagatcgacatcgacaccggcgagatctccacccagaccaccttcagcccgaaggacctcagccccgagtacatcatgaaccccgacaactacgccgagctggcgtcccacatcttccgcgtccagagcatctccaagacgccccaggggaaccgggacgtgcgcatctacctgttcaagcagcagtacatcagcggctcccagaaggacagcctccacctgaaggggatcacctaccggcagatctccagcgccaaggacctggccgagctcgtgaagatccgcgtcaaccacctgggccggatcgtgtccgtgggcgagaagtga

SEQ ID NO: 2183 - RNA, 4287 nt, synthetic construct
  misc_feature 1..4287: note = Cas9 variant
  source 1..4287: mol_type = other RNA
atgaccaagaagatcctgggcctcgacctggggaccacgagcatcggctgggcctacgtgatcgagtccgacaaccccgacgagagcgagatcaagcagatcggggtccgcgtgaacccgctgaccaccgacgagcagaccaacttcgagaagggcaagcccttctccatcaacaaggagcggacgctcaagcgcggggcccggcgcaacctggaccggtacaaggaccgccggaacaacctgatcgaggtgctcaagaaggcgaacatcctgagccaggactccatcctgaccgaggagggccagcacaccacccaccagacgtggcagctccgcgccaaggccgccgtcgacaagatcgagaaggaggagctggcccgggtgctgctcgcgatcaacaagaagcgcggctacaagagctcccggaaggccaagaacgaggacgaggggcaggccatcgacggcatggccgtggcgaagcgcctgtacgacgagcagatcacgtgcgggcagctggtctaccagctcctgcgggagggcaagaagtccatccccgacttctaccgctccgacctgcaggccgagttcgacaaggtgtggaacttccagaagcagttctaccccaagatcctcaccgacgagttctacaaggagctgaaggggaagggccagcgggccaccagcgccctgttctacaagacctacaacttcaacaccgccgagaacaagggctcccgcgaggagaagaagatccaggcgtacaagtggcggagcgaggccatctcccagcagctcgagaaggaggaggtggccttcgtcctgaccgagatcaacaacaacctgaacaacagctccgggtacctcggcgccatcagcgaccgctccaaggagctgtacttcaacaagcagaccgtggggcagtacctgtaccagcagctccaggagaaccggcacgcccgcctgaagaaccaggtgttctaccggcaggactacctggacgagttcgaggcgatctggaaggagcaggccaagcaccacacggagctcaccgaggagctgaaggccgagatccgcgacatcatcatcttctaccagcgcaagctcaagagccagaagggcctgatctccttctgcgagttcgagagccgggagatccagatcgacggcaagaagaagaccatcgggctgcgcgtcgcccccaagagcagccccctgttccaggagttcaagatctggcagaacctcaacaacgtgctggtgcggaagaagggcagccgcaagcggaacgtcaagcaggagatccaggggtccctgttcgaggaggagaaggagatcttcgtgttcgacctcgagaccaaggagaagctgttcgaggagctgaacctcaagggcaacctgagcgccaacaaggtgatcgagctgctcgggcacaagcccacggagtgggagatcaactactccgcgctggagggcaaccgcaccaaccaggccctgtacaacgcctacctcaagatcctggacatcgagggctacgacgaggacctgctgaagctcagcgacaaggacgacatcaacgtcgccgacctgaagacccccgcctccgagatcaagaacatggtgcgggacatcttccaggtgctggggatcagcaccgacatcctcgagttcgacgcggagctggacggcaaggacttcgagcagcaggcctcctaccagctgtggcacctcctgtacagctacgagggggacgactcccagagcggcaacgagaagctgtacgagctcctggagaagaagttcgggttcaagaaggagcactcccaggtcctggccaacgtgacgctcagcgacgactacggcaacctgtccagcaaggccatgcgcaagatctacccgttcatcaaggagaacaactactccaccgcgtgcgagctggccggctaccggcacagcaagcactccctcaccaaggaggagatcgagaaccgccccctggacgacaagctggagctcctgaagaagaacagcctgcggcagcccgtggtcgagaagatcctcaaccagatggtgaacgtcgtgaacagcctgctggagaagaaccgcaaggagaaccccgacttccggttcgacgagatccgcatcgagctcgcccgggagctgaagaagaacgccaaggagcgcgccgagatgaccacgaacatcaactccgcgaagaccgagaacgagaagatcttcaagctgctccaggccgagttcgggctgaagaacccgacccggaacgacatcatccgctaccggctgtacgaggagctcaagaacaacggctacaaggacctgtacaccaacaagtacatcccccgcgagatcctgttcagcaagcaggtcgacatcgagcacatcatcccccagtcccgcctcttcgacgacagcttctccaacaagacgatcgtgtaccgggagaccaacctggacaaggggaaccagaccgccttcgactacatcgacagcaagtacggcaacgagaaggtggaggagtacatcctgcgcatcgaggccctccacgacgcctggaagaagaacaaggaggaggggatctccaaggcgaagtaccagaagctgctgaagaaggagaccgagatcggcgacggcttcatcgagcgggacctccgcgagagccagtacatcgccaagaaggccaaggagatgctgttcaagatcacgcggtccgtggtcagcacctccgggagcatcaccgacaagctgcgcgaggactggggcctcatcaacatcatgaaggagctgaacctgcccaagtaccggtccctcgggctgaccgagatgcaggagcgcaagttcggccagaaggtggaggtgatcaacgactggaccaagcggaacgaccaccgccaccacgccatggacgccctgacggtcgcgttcaccaagcacaaccacatccagtacctcaactacctgaacgcccggaagaacgagaaccacaagctgcacaacaacatcatcgccatcgagaacctcgagaccgagaccatgatcgacaacaacggcagcaagcgccgggtgttcaaggccccgatgcccaacttccgccaggtggcgaaggagcacctggagaacgtcctgatctcccacaaggccaagaacaaggtggtgacgaagaacaagaacaagatcgccgggaaggtcgccgcccaggagaccctcaccccgcggggccagctgcacaaggagaccgtgtacgggaagtaccagtactacgtgaacaaggaggagaagatcggcacgaagttcgacgaggagaccatcaacaaggtcagcaacccccagtaccgcaagctgctcctggagcggctgtccgcgaacgggaacgacccgaagaaggccttcagcggcaagaacgccctcagcaagaaccccatctacctgaacgagaccaagaccgagacggtgcccgaggtggtcaagctgacctggctcgaggaggactactccatccgcaaggacatcacccccgacaacttcaaggacgagaagtccatcgacaagatcctggacgagggcgtgaagcggatcctgaagaagcgcctccggaagaacgacaacgacccgaagaaggccttcagcgacctggacaagaaccccatctggctgaacgaggagaaggggatcagcatcaagcgcgtgaccatctccggcgtcaacaacgccgagcccctccactacaagaaggaccacttcgggaacgacatcctggacgagaagggcgacaagatccccgtggacttcgtgagcacggggaacaaccaccacgtcgcggtgtaccgcgacgagaagggcaacctgcaggagaacatcgtgtccttcttcgaggccgtcatccgggtgaaccagggcctcccgatcatcgacaaggcctacaaccagcacctggggtggcagttcctgttcaccatgaagcagaacgagatgttcgtgttccccaacgagaagtccggcttcaacccccaggagatcgacctcctggacccgagcaacaagaagaagatcagccccaacctgttccgcgtccagaagatgtccaaggtgatctacgggaacagccccgtgcgggagtacgtcttccgccaccacctcgagaccaacgtggacgagaagaaggagctgaaggacatcaccttcaagaacatcaagtccctgggctacttcgaggacatcgtgaaggtccggatcaaccacctcggggacatcgtgagcgtgggcgagtactga

SEQ ID NO: 2184 - RNA, 4293 nt, synthetic construct
  misc_feature 1..4293: note = Cas9 variant
  source 1..4293: mol_type = other RNA
atgaagcacatcctgggcctcgacctggggaccaacagcatcggctgggccgtggtcaaggaggcccagaacgacaacgagcagtccgagatcgtggacgtgggggtccgcgtgaaccccctgaccacggacgagaagaccaacttcgagaagggcaagccgatcagcaccaacgcggaccggaccctcaagcgctccgcccggcgcaacctgcagcggtacaagctgcgccggaaggagctcatcgagctgctgaaggagcaccagctcatcagcacggacaccatcctgaccgagaacgggaagggcaccacgttccagaccctggagctccgcgccaagtccgccaaggagaagatcagcctggaggagctggcccgggtgttcctcaccatcaacaagaagcgcggctacaagtccagccggaaggcgaagaacgaggacgaggggcagctgatcgacggcatggagatcgccaagcgcctgtacgaggagaacctcaccacggggcagctgtccctgcagctcctgaaggagggcaagaagtccctgcccgactactaccggagcgacctccagttcgagctggacaaggtctggaacttccagaagcagttccacagcgacatcctgaccgacgagttctacgcccagctcaaggggaagggccagcgcgccacctccgcgctgttcctggccaagtaccagatctacaccgccgagaacaagggcagccgggaggacaagaagctccaggcctaccagtggcgcgtggacgccctgtccaaggagctgacgcgggagcagctcgcgttcgtgatcaccgagatcaacaacaacctgaacaacagctccgggtacctgggcgccatcagcgaccgctccaaggagctctacttcaacaacgagaccgtcggggagtacctgtggaagcagatcgccgccaacccccacaccagcctgaagaaccaggtgttctaccggcaggactacctcgacgagttcgagcagatctggaagacgcagagcgccttctaccccgagatcctgaccgacgagctgaagaaggagctccgcgacgtggtcatcttctaccagcggaagctgaagtcccagaagtccctggtgagcttctgcgagttcgagaacaaggagatcgagatcaagaaggaggacggcaccagcaccaagaaggtgatcggcctcaaggtcgcgccgaagtccagccccctgttccaggagttcaagatctggcagaacctgaacaacgtgctcatccgcaagaaggggtccaagacgaagaaggtggccaagaaccagcaggccgtcctgttcgaggaggagaagaccatcagcgagctggacctggaggccaagcaggccctcttcaacgagctgaacctgaagggcaacctcaaggcggactactgcctggagatcctggggtactcccccaaggagtgggagatgaactacagcgtgctcgagggcaaccgcaccaacaaggccctgtacgaggcctacctgaagatcaccgacctcgaggggtacgacgccaagaaccacctgaaggtgaagctgaacaaggacgaggtcgagctcgacgacctgaaggtgcccgcctccgagatcaaggacatggtgcaggcgatcttcaaggaggccggcatcaacacggacatcctgcacttcaacgccgagctcgacggcaaggacttcgagaaccaggccagctaccagctgtggcacctcctgtactcctacgagggggacgacagcaagtccggcaacgagctgctgtacaagctcctggagaccaagttcgggttcaagaaggagtacgcgcagatcctggccaacgtcagcctctccgacgactacggcagcctgtccaccaaggccatgcggaagatccacccgtacatcaaggagaacaagttcagcaccgcctgcgagctggccgggtaccgccacagcaagcactccctcacgaaggaggagaacgacaaccgggtgctgaaggacagcctggaggtcctcaagaagaactccctgcgccagcccgtggtggagaagatcctgaaccagatgatcaacctcgtcaacgcgctgctgaagaagtaccggaccgagaaccccaacttcaagttcgacgagatccgcatcgagctcgcccgggagctgaagaagaacgccgaggagcgcgccaacatgaccgccaacatcaacaaggcgaagaccgagcacgagaagatcatcaagatcctgaagaacgagttcggcctccccaacccgacgcggaacgacatcatccgctaccggctgtacgaggagctgaaggccaacggctacaaggacctctacaccaacatcaagatcccccaggagaagctgttcaccaaggagatcgacatcgagcacatcatccccaagagccgcgtgttcgacgactccttcagcaacaagaccctgtccttccggaagaccaacctcgacaagggggagcgcacggccttcgactacatggagagcaagttcggcgccgacaagctggaggagtacgtggcccgggtcgaggacctgtacaagaacaacatcatctccaaggcgaagtaccagaagctcctgaagaaggagagcgagatcggggacggcttcgtggagcgcgacctgcgggagacccagtacatcgccaagaaggccaaggagatcctcctgcagatcacccccaacgtgctgtccaccagcgggggcatcacggaccgcctccgggaggactgggacctgatcaacgtcatgaaggagctgaacctcccgaagtaccgcgccctgggcctgacccagatggaggaccgcaagtacgggcagcaggtcgaggtgatcaccgactggaccaagcggaacgaccaccgccaccacgcgatggacgccctcacggtggccttcaccaagcacaaccacatccagtacctgaactacctgaacgcccggaagaacgagaagcacaaggagcactccaacatcatgggcatccagcagctcgagaccatcaaggtgaccgacaagaacgggaacgagaagcgcgtgttcaaggcccccatgcccaacttccggcaggtcacgaaggcgttcctggagaacatcctgatcagccacaaggccaagaacaaggtggtgaccaagaacaagaacaaggtcgccggctccaacaaggtgcaggaggtgctcacgccccgcggccagctgcacaaggagaccgtctacgggaagtaccagtactacgtgcagaaggaggagaagatcggcgccaagttcgacctggagaccatcaagaaggtggccaacccgctctaccagagcctgctgaagaagcggctcgaggagaacgggggcgaccccaagaaggcgttcaccgggaagaactccctggccaagaaccccatctacctggacgacacccagaccgagcagctccccgagaaggtcaagctggtgtggctggagaacagcttcagcatccgcaaggacatcacgccggagaacttcaaggacgagaagctcatcgacaagatcctggacgagggcgtgaagcggatcctgaaggagcgcctccagtccttcggcaacgacgccaagaaggccttcagcgacctggacaagaaccccatctggctgaacaaggagaaggggatcaccatcaagcgggtcaccatctccggcgtggccaacgcggagcccctccacaccaagaaggaccacctggggaaggagatcctggacaaggagggcaagcccatcccggtggacttcatcagcacggggtccaaccaccacgtcgccgtgtaccgcgacgagaagggcaacctccaggagaaggtggtcagcgtgttcgaggccgtggtccgggccaaccagggcctgcccatcatcgacaagacctacaaccagcacctggggtgggagttcctcttcaccatgaagcagaacgagatgttcgtgttccccaacgagtccaccggcttcaacccgaacgacatcgacctgctggaccccaagaacaagcgcatcatcagccccaacctcttccgggtgcagaagttctccaagctgcagtacgggaacagcttcgtccgcgagttcgtgttccggcaccacctggagacgaccgtggaggaccgcaaggagctgcagggcatcacctacaagcagatgaagaactccaccttcttcaacgacatcatcaaggtccggatcaaccacctcggggacatcgtgagcatcggcgagtactga

SEQ ID NO: 2185 - RNA, 4293 nt, synthetic construct
  misc_feature 1..4293: note = Cas9 variant
  source 1..4293: mol_type = other RNA
atgaagcacatcctgggcctcgacctggggaccaacagcatcggctgggccgtggtcaaggaggcccagaacgacaacgagcagtccgagatcgtggacgtgggggtccgcgtgaaccccctgaccacggacgagaagaccaacttcgagaagggcaagccgatcagcaccaacgcggaccggaccctcaagcgctccgcccggcgcaacctgcagcggtacaagctgcgccggaaggagctcatcgagctgctgaaggagcaccagctcatcagcacggacaccatcctgaccgagaacgggaagggcaccacgttccagaccctggagctccgcgccaagtccgccaaggagaagatcagcctggaggagctggcccgggtgttcctcaccatcaacaagaagcgcggctacaagtccagccggaaggcgaagaacgaggacgaggggcagctgatcgacggcatggagatcgccaagcgcctgtacgaggagaacctcaccacggggcagctgtccctgcagctcctgaaggagggcaagaagtccctgcccgactactaccggagcgacctccagttcgagctggacaaggtctggaacttccagaagcagttccacagccacatcctgaccgacgagttctacgcccagctcaaggggaagggccagcgcgccacctccgcgctgttcctggccaagtaccagatctacaccgccgagaacaagggcagccgggaggacaagaagctccaggcctaccagtggcgcgtggacgccctgtccaaggagctgacgcgggagcagctcgcgttcgtgatcaccgagatcaacaacaacctgaacaacagctccgggtacctgggcgccatcagcgaccgctccaaggagctctacttcaacaacgagaccgtcggggagtacctgtggaagcagatcgccgccaacccccacaccagcctgaagaaccaggtgttctaccggcaggactacctcgacgagttcgagcagatctggaagacgcagagcgccttctaccccgagatcctgaccgacgagctgaagaaggagctccgcgacgtggtcatcttctaccagcggaagctgaagtcccagaagtccctggtgagcttctgcgagttcgagaacaaggagatcgagatcaagaaggaggacggcaccagcaccaagaaggtgatcggcctcaaggtcgcgccgaagtccagccccctgttccaggagttcaagatctggcagaacctgaacaacgtgctcatccgcaagaaggggtccaagacgaagaaggtggacaagaaccagcaggccgtcctgttcgaggaggagaagaccatcttcgagctggacctggaggccaagcaggccctcttcaacgagctgaacctgaagggcaacctcaaggcctactactgcctggagatcctggggtacagccccaaggagtgggagatgaactactccgtgctcgagggcaaccgcaccaacaaggcgctgtacgaggcctacctgaagatcaccgacctcgaggggtacgacgccaagaaccacctgaaggtgaagctgaacaaggacgaggtcgagctcgacgacctgaaggtgcccgccagcgagatcaaggacatggtgcaggccatcttcaaggaggcgggcatcaacacggacatcctgcacttcaacgccgagctcgacggcaaggacttcgagaaccaggcctcctaccagctgtggcacctcctgtacagctacgagggggacgactccaagagcggcaacgagctgctgtacaagctcctggagaccaagttcgggttcaagaaggagtacgcccagatcctggcgaacgtctccctcagcgacgactacggctccctgagcaccaaggccatgcggaagatccacccgtacatcaaggagaacaagttctccaccgcctgcgagctggccgggtaccgccacagcaagcacagcctcacgaaggaggagaacgacaaccgggtgctgaaggactccctggaggtcctcaagaagaacagcctgcgccagcccgtggtggagaagatcctgaaccagatgatcaacctcgtcaacgccctgctgaagaagtaccggaccgagaaccccaacttcaagttcgacgagatccgcatcgagctcgcgcgggagctgaagaagaacgccgaggagcgcgccaacatgaccgtgaacatcaacaaggccaagaccgagcacgagaagatcatcaagatcctgaagaacgagttcggcctccccaacccgacgcggaacgacatcatccgctaccggctgtacgaggagctgaaggccaacggctacaaggacctctacaccaacgagtacatcgagaagcaggacctgttcaccaagaacatcgacatcgagcacatcatccccaagtcccgcgtgttcgacgacagcttctccaacaagaccctgagcttccggaagaccaacctcgacaagggggagcgcacggcgttcgactacatcgagtccaagttcggcgccgacaagctggaggagtacgtcgcccgggtggaggacctgtacaagaacaacatcatcagcaaggccaagtaccagaagctcctgaagaaggagtccgagatcggggacggcttcgtggagcgcgacctgcgggagacccagtacatcgccaagaaggcgaaggagatcctcctgcagatcacccccaacgtcctgagcacctccgggggcatcacggaccgcctccgggaggactgggacctgatcaacgtgatgaaggagctgaacctccccaagtaccgcgccctgggcctgacccagatggaggaccgcaagtacgggcagcaggtcgaggtgatcatcgactggaccaagcggaacgaccaccgccaccacgccatggacgccctcaccgtggcgttcacgaagcacaaccacatccagtacctgaactacctgaacgcccggaagaacgagaagcaccgcgagcacagcaacatcatgggcatccagcagctcgagaccatcaaggtgaccgacaagaacgggaacgagaagcgggtcttcaaggccccgatgcccaacttccgccaggtgaccaaggccttcctggagaacgtgctgatctcccacaaggccaagaacaaggtcgtgacgaagaacaagaacaaggtggcgggcagcaacaaggtccaggaggtgctcacgccccggggccagctgcacaaggagaccgtgtacgggaagtaccagtactacgtccagaaggaggagaagatcggcgggaagttcgacctggagaccatcaagaaggtggccaaccccctctaccagtccctgctgaagaagcgcctcgaggagaacggcggggacccgaagaaggccttcaccggcaagaacagcctggccaagaaccccatctacctggacgacgcccagaccgagcagctccccgagaaggtgaagctggtctggctggagaactccttcagcatccggaaggacatcacccccgagaacttcaaggacgagaagctcatcgacaagatcctggacgagggcgtgaagcgcatcctgaaggagcggctccagagcttcgggaacgacgcgaagaaggccttctccgacctggacaagaacccgatctggctgaacaaggagaagggcatcgccatcaagcgcgtggccatcagcggggtcgccaacgcggagcccctccacaccaagaaggaccacctgggcaaggagatcctggacaaggaggggaagtccatccccgtggacttcatcagcacgggcaacaaccaccacgtggccgtctaccgggacgagaagggcaacctccaggagaaggtggtgtccgtcttcgaggccgtggtgcgcgccaaccaggggctgcccatcatcgacaagacctacaaccagcacctgggctgggagttcctcttcaccatgaagcagaacgagatgttcgtcttcagcaacgagtccaccgggttcaacccgaacgacatcgacctgctggaccccaagaacaagaagatcatcagccccaacctcttccgggtgcagaagttctccaagctgcagtacggcaacagcttcgtgcgcgagttcgtcttccggcaccacctggagacgaccgtggaggaccgcaaggagctgcaggggatcacctacaagcagatgaagaactccgcgttcttcaacgacatcatcaaggtgcggatcaaccacctcggcggcatcgtcagcgtgggggagtactga

SEQ ID NO: 2186 - RNA, 4293 nt, synthetic construct
  misc_feature 1..4293: note = Cas9 variant
  source 1..4293: mol_type = other RNA
atgaaggacatcctgggcctcgacctggggaccaacagcatcggctgggccgtggtcaaggaggcccagaacgacaacgagacctccgagatcgtggacctgggggtgcgcgtcaaccccctcacgaccgacgagaagaccaacttcgagaagggcaagccgatcagcaccaacgcggaccggacgctgaagcgctccgcccggcgcaacctgcagcggtacaagctccgccggaaggagctgatcgagctgctcaaggagcaccagctgatcagcaccgacaccatcctgaccgagaacgggaagggcacgtccttccagaccctcgagctgcgcgccaagagcgccaaggagaagatctccctggaggagctcgcccgggtgttcctgaccatcaacaagaagcgcggctacaagagctcccggaaggcgaagaacgaggacgaggggcagctgatcgacggcatggagatcgccaagcgcctctacgaggagaacctgaccacggggcagctgagcctccagctgctgaaggagggcaagaagtccctccccgactactaccggagcgacctgcagttcgagctggacaaggtgtggaacttccagaagcagttccactcccacatcctcaccgacgagttctacgcccagctgaaggggaagggccagcgcgccaccagcgcgctgttcctcgccaagtaccagatctacaccgccgagaacaagggctcccgggaggacaagaagctgcaggcctaccagtggcgcgtcgacgccctgagcaaggagctcacgcgggagcagctggcgttcgtgatcaccgagatcaacaacaacctgaacaactccagcgggtacctcggcgccatctccgaccgcagcaaggagctgtacttcaacaacgagaccgtgggggagtacctgtggaagcagatcgccgccaacccccacaccagcctcaagaaccaggtcttctaccggcaggactacctggacgagttcgagcagatctggaacacgcaggcccagttctacccccagatcctgaccgacgagctcaagaaggagctgcgcgacgtggtgatcttctaccagcggaagctgaagtcccagaagtccctcgtctccttctgcgagttcgagaacaaggagatcgagatcaagaaggaggacggcaccagcaccaagaaggtgatcggcctgaaggtggcgccgaagtccagccccctgttccaggagttcaagatctggcagaacctcaacaacgtcctgatccgcaagaaggggtccaagacgaagaaggccgccaagaaccagcaggccgtgctgttcgaggaggagaagaccatcagcgagctggacctcgaggccaagcaggcgctgttcaacgagctgaacctcaagggcaacctgaaggccgactactgcctggagatcctcgggtactcccccaaggagtgggagatgaactacagcgtgctggagggcaaccgcaccaacaaggccctgtacgaggcctacctcaagatcaccgacctggaggggtacgacgccaagaaccacctgaaggtcaagctcaacaaggacgaggtggagctggacgacctgaaggtgcccgcgtccgagatcaaggacatggtccaggccatcttcaaggaggccggcatcaacacggacatcctccacttcaacgccgagctggacggcaaggacttcgagaaccaggcgagctaccagctgtggcacctcctgtactcctacgagggggacgacagcaagtccggcaacgagctgctctacaagctgctggagaccaagttcgggttcaagaaggagtacgcccagatcctcgccaacgtgagcctgtccgacgactacggcagcctgtccaccaaggccatgcggaagatccacccgtacatcaaggagaacaagttcagcaccgcctgcgagctcgcggggtaccgccacagcaagcactccctgacgaaggaggagaacgacaaccgggtgctgaaggacagcctcgaggtcctgaagaagaactccctgcgccagcccgtggtcgagaagatcctcaaccagatgatcaacctggtgaacgccctgctcaagaagtaccggaccgagaaccccaacttcaagttcgacgagatccgcatcgagctggcccgggagctgaagaagaacgccgaggagcgcgccaacatgaccgcgaacatcaacaaggccaagaccgagcacgagaagatcatcaagatcctcaagaacgagttcggcctgcccaacccgacgcggaacgacatcatccgctaccggctgtacgaggagctcaaggccaacggctacaaggacctgtacaccaacatcaagatcccccaggagaagctgttcaccaaggagatcgacatcgagcacatcatccccaagagccgcgtgttcgacgactccttcagcaacaagaccctctccttccggaagaccaacctggacaagggggagcgcacggccttcgactacatggagagcaagttcggcgccgacaagctggaggagtacgtcgcgcgggtggaggacctctacaagaacaacatcatctccaaggccaagtaccagaagctgctgaagaaggagagcgagatcggggacggcttcgtggagcgcgacctccgggagacccagtacatcgccaagaaggccaaggagatcctgctgcagatcacccccaacgtcctctccaccagcgggggcatcacggaccgcctgcgggaggactgggacctgatcaacgtgatgaaggagctcaacctgccgaagtaccgcgcgctgggcctcaccgagatggaggaccgcaagtacgggcagcaggtcgaggtgatcatcgactggaccaagcggaacgaccaccgccaccacgccatggacgccctgaccgtggccttcacgaagcacaaccacatccagtacctgaactacctcaacgcccggaagaacgagaagcacaaggagcactccaacatcatgggcatccagcagctggagaccatcaaggtgaccgacaagaacgggaacgagaagcgcgtcttcaaggcgcccatgcccaacttccgccaggtgaccaaggccttcctggagaacatcctcatcagccacaaggccaagaacaaggtggtcacgaagaacaagaacaaggtggccggctccaacaaggtgcaggaggtcctgacgccccggggccagctgcacaaggagaccgtgtacgggaagtaccagtactacgtgcagaaggaggagaagatcggcgggaagttcgacctcgagaccatcaagaaggtcgccaacccgctgtaccagagcctgctcaagaagcggctggaggagaacggcggggaccccaagaaggcgttcaccggcaagtactccctggccaagaaccccatctacctcgacgacgcccagaccgagcagctgcccgagaaggtgaagctggtgtggctcgagaacagcttcagcatccgcaaggacatcaccccggagaacttcaaggacgagaagctgatcgacaagatcctggacgagggcgtcaagcggatcctcaaggagcgcctgcagtccttcgggaacgacgccaagaaggccttcagcgacctggacaagaaccccatctggctcaacaaggagaagggcatcaccatcaagcgggtgacgatctccggggtggcgaacgccgagcccctgcacaccaagaaggaccacctgggcaaggagatcctcgacaaggaggggaagcccatcccggtcgacttcatcagcaccggctccaaccaccacgtggccgtgtaccgcgacgagaagggcaacctgcaggagaaggtcgtgagcgtgttcgaggccgtcgtgcgggcgaaccaggggctgcccatcatcgacaagacctacaaccagcacctcggctgggagttcctgttcacgatgaagcagaacgagatgttcgtgttccccaacgagtccaccgggttcaacccgaacgacatcgacctgctcgaccccaagaacaagcgcatcatcagccccaacctgttccgggtccagaccatctccgtggtgaagtacggcaacgccatcgtccgcgacttcaagttccggcaccacctggagaccacggtggaggacaagaaggagctgcaggggaagacctaccagcagatcaagagcctcagccccctgaacgacatcatcaaggtgcgcatcaaccacctgggcgacatcgtcagcgtgggcgagtactga

SEQ ID NO: 2187 - RNA, 4293 nt, synthetic construct
  misc_feature 1..4293: note = Cas9 variant
  source 1..4293: mol_type = other RNA
atgaagcacatcctgggcctcgacctggggaccaacagcatcggctgggcctacgtgaaggaggccgagaacgacaccgagacgtccgagatcgtcgacctgggggtgcgcgtgaaccccctcaccaccgacgagaagaccaacttcgagaagggcaagccgatcagcacgaacgcggaccggaccctgaagcgctccgcccggcgcaacctgcagcggtacaagctccgccggaaggagctgatcgagctgctcaaggagcaccagctgatcagcgagaacaccatcctgaccgagaacgggaagggcacgaccttccagaccctcgagctgcgcgccaagtccgccaaggagaagatcagcctgggcgagctcgcccgggtcttcctgaccatcaacaagaagcgcgggtacaagtccagccggaaggcgaagaacgaggacgagggccagctgatcgacgggatggagatcgccaagcgcctctacgaggagaacctgacgaccggccagctgtccctccagctgctgaaggaggggaagaagtccctccccgactactaccggtccgacctgcagttcgagctggacaaggtgtggaacttccagaagcagttccacagcgacatcctcaccgacgagttctacgcccagctgaagggcaagggccagcgcgccacctccgcgctgttcctcgccaagtaccagatctacacggccgagaacaaggggagccgggaggacaagaagctgcaggcctaccagtggcgcgtggacgccctgtccaaggagctcacccgggagcagctggcgttcgtcatcaccgagatcaacaacaacctgaacaacagctccggctacctcggggccatcagcgaccgctccaaggagctgtacttcaacaacgagaccgtgggcgagtacctgtggaagcagatcgccgccaacccccacacgagcctcaagaaccaggtgttctaccggcaggactacctggacgagttcgagcagatctggaacacccaggcccagttctacccccagatcctgaccgacgagctcaagaaggagctgcgcgacgtcgtgatcttctaccagcggaagctgaagtcccagaagtccctcgtgagcttctgcgagttcgagaacaaggagatcgagatcaagaaggaggacggcacctccacgaagaaggtcatcgggctgaaggtggcgcccaagagcagccccctgttccaggagttcaagatctggcagaacctcaacaacgtgctgatccgcaagaagggcagcaagaccaagaaggccgccaagaaccagcaggccgtcctgttcgaggaggagaagaccatctccgagctggacctcgaggccaagcaggcgctgttcaacgagctgaacctcaaggggaacctgaaggccgactactgcctggagatcctcggctacagccccaaggagtgggagatgaactactccgtgctggaggggaaccgcaccaacaaggccctgtacgaggcctacctcaagatcacggacctggagggctacgacgccaagaaccacctgaaggtgaagctcaacaaggacgaggtcgagctggacgacctgaaggtgcccgcgagcgagatcaaggagatggtgcaggccatcttcaaggaggccggcatcaacaccgacatcctccacttcaacgccgagctggacgggaaggacttcgagaaccaggcgtcctaccagctgtggcacctcctgtacagctacgagggcgacgactccaagagcgggaacgagctgctctacaagctgctggagaccaagttcggcttcaagaaggagtacgcccagatcctcgccaacgtctccctgagcgacgactacgggaacctgtccaccaaggccatgcggaagatctacccgtacatcaaggagaacaagttcagcacggcctgcgagctcgcgggctaccgccactccaagcacagcctgaccaaggaggagaacgacaaccgggtgctgaaggacagcctcgaggtgctgaagaagaactccctgcgccagcccgtcgtggagaagatcctcaaccagatgatcaacctggtcaacgccctgctcaagaagtaccggaccgagaaccccaacttcaagttcgacgagatccgcatcgagctggcccgggagctgaagaagaacgccgaggagcgcgccaacatgaccgcgaacatcaacaaggccaagacggagcacgagaagatcatcaagatcctcaagaacgagttcggcctgcccaacccgacccggaacgacatcatccgctaccggctgtacgaggagctcaaggccaacgggtacaaggacctgtacaccaacatcaagatcccccaggagaagctgttcaccaaggagatcgacatcgagcacatcatccccaagagccgcgtgttcgacgactccttcagcaacaagaccctctccttccggaagacgaacctggacaagggcgagcgcaccgccttcgactacatggagagcaagttcggggccgacaagctggaggagtacgtggcgcgggtcgaggacctctacaagaacaacatcatctccaaggccaagtaccagaagctgctgaagaaggagagcgagatcggcgacgggttcgtggagcgcgacctccgggagacccagtacatcgccaagaaggccaaggagatcctgctgcagatcacccgcaacgtgctctccacgagcggcggcatcaccgaccggctgcgcgaggactgggacctggtcaacgtgatgaaggagctcaacctgcccaagtaccgcgcgctggggctcaccgagatggaggaccggaagtacggccagcaggtcgaggtgatcatcgactggaccaagcgcaacgaccaccggcaccacgccatggacgccctgacggtggccttcaccaagcacaaccacatccagtacctgaactacctcaacgcccgcaagaacgagaagcaccgggagcactccaacatcatggggatccagcagctggagaccatcaaggtgaccgacaagaacggcaacgagaagcgcgtcttcaaggcgccgatgcccaacttccgccaggtgacgaaggccttcctggagaacgtgctcatcagccacaaggccaagaacaaggtcgtgaccaagaacaagaacaaggtggccggctccaacaaggtccaggaggtgctgaccccgcgggggcagctgcacaaggagaccgtgtacggcaagtaccagtactacgtccagaaggaggagaagatcgggggcaagttcgacctcgagacgatcaagaaggtggccaaccccctgtaccagagcctgctcaagaagcggctggaggagaacgggggcgacccgaagaaggcgttcaccggcaagaactccctggccaagaaccccatctacctcgacgacgcccagaccgagcagctgcccgagaaggtgaagctggtctggctcgagaacagcttctccatccgcaaggacatcacccccgagaacttcaaggacgagaagctgatcgacaagatcctggacgagggggtgaagcggatcctcaaggagcgcctgcagagcttcggcaacgacgccaagaaggccttcagcgacctggacaagaacccgatctggctcaacaaggagaaggggatcacgatcaagcgggtgaccatctccggcgtcgcgaacgccgagcccctgcacaccaagaaggaccacctggggaaggagatcctcgacaaggagggcaagcccatccccgtggacttcatcagcaccggctccaaccaccacgtggccgtctaccgcgacgagaaggggaacctgcaggagaaggtggtgagcgtcttcgaggccgtggtgcgggcgaaccagggcctgccgatcatcgacaagacgtacaacgagcacctcgggtgggagttcctgttcaccatgaagcagaacgagatgttcgtcttccccaacgagtccaccggcttcaaccccaacgacatcgacctgctcgacccgaagaacaagcgcatcatcagccccaacctgttccgggtgcagaccatctccgtggtcaagtacgggaacgccatcgtgcgcgacttcaagttccggcaccacctggagacgaccgtggaggacaagaaggagctgcagggcaagacctaccagcagatcaagagcctcagccccctgaacgacatcatcaaggtccgcatcaaccacctgggcgacatcgtgagcgtgggggagtactga

SEQ ID NO: 2188 - RNA, 4293 nt, synthetic construct
  misc_feature 1..4293: note = Cas9 variant
  source 1..4293: mol_type = other RNA
atggcccagaagtacatcctgggcctcgacctggggaccaacagcatcggctgggccgtggtcaaggaggcggagaacgacaacgagcagtccgagatcgtggacgtgggggtccgcgtgaaccccctgaccacggacgagaagaccaacttcgagaagggcaagccgatcagcaccaacgccgaccggaccctcaagcgcggggcccggcgcaacctgcagcggtacaagctgcgccggaaggagctcatcaagatcctgaaggagcaccagctgatctccgacgacacgatcctcgccgagaacggcaagggcaccacctaccagaccctgaagctgcgcgccaagagctccaaggagaagatcagcctcgaggagctggcgcgggtgttcctgacgatcaacaagaagcgcgggtacaagtccagccggaagaccaagaacgaggacgagggccagctcatcgacgggatggagatcgccaagcgcctgtacgaggagaacctgaccaccggccagctctccctgcagctgctcaaggaggggaagaagtccctgcccgactactaccggagcgacctggagctcgagctggacaaggtctggaacttccagaagcagttccacagcgacatcctgacggacgagttctacacccagctcaagggcaagggccagcgcgccacctccgccctgttcctggagaagtaccagatctacaccgtggagaacaaggggaaccgggaggagaagaacctccaggcgtaccagtggcgcgtggacgccctgagcaaggagctgacgcgggaggagctcgccttcgtcatcaccgagatcaacaacaacctgaacaactccagcggctacctgggggccatctccgaccgcagcaaggagctctacttcaacaacgagaccgtgggcgagtacctgtggaagcagatcgccgcgaacccccacacctccctgaagaaccaggtgttctaccggcaggactacctcgacgagttcgagcgcatctggaacacgcaggcccagttctacccccagatcctgaccgagagcctgaagaaggagctccgggacgtcgtgatcttctaccagcgcaagctcaagagccagaagtccctggtgagcttctgcgagttcgagaacaaggagatcgagatcaagaacgaggacggcaccaccacgaagaaggtcatcgggctcaaggtggccccgaagtccagccccctgttccaggagttcaagatctggcagaacctgaacaacgtgctcatccgcaagaagggctccaagaccgagaaggtcgccaagaaccagcaggtcgtgctgttcgaggaggagaagaccatcagcgagctggacctggaggccaagcaggcgctgttcaacgagctgaacctgaaggggaacctcaaggccgactactgcctggagatcctgggctactccagcaaggagtgggagatgaactactccgtgctcgaggggaaccggaccaacaaggccctgtacgaggcctacctgaagatcacggacctcgagggctacgacgccaagaactacctgaaggtcaagagcaacaaggacgaggtggagctggacgacctcaaggtgcccgcgtccgagatcaaggagatggtgcaggccatcttcaaggaggccggcatcaacaccgacatcctgcacttcgacgccgagctggacgggaaggacttcgagaaccagggcagctacaagctctggcacctcctgtactcctacgagggggacgacagcaagtccggcaacgagctgctgtacaagctgctcgagaccaagttcgggctgaagaaggagtacgcccagatcctggcgaacatcagcctctccgacgactacggcaacctgagcaccaaggccatgcgcaagatccacccctacatcaaggagaacaagttctccacggcctgcgagctggccggctaccggcacagcaagcacagcctcaccaaggaggagaacgagaagcgcgtcctgaaggacgggctggaggtgctcaagaagaactccctgcggcagccggtggtcgagaagatcctgaaccagatgatcaacctcgtgaacgcgctgctgaagaagtaccgcaccgagaaccccaacttcaagttcgacgagatccggatcgagctcgcccgcgagctgaagaagaacgccgaggagcgggccaacatgaccgccaacatcaacaaggcgaagacggagcacgagaagatcgacaagatcctcaagagcgagttcggcctgcccaaccccacccgcaacgacatcatccggtaccgcctgtacgaggagctgaaggccaacgggtacaaggacctctacaccaaccggtacatctccagcgagaagctgttctccaaggagatcgacatcgagcacatcatccccaagagccgcgtgttcgacgactccttcagcaacaagaccatcgtctaccggaccgacaacctggacaagggcgagcagacggcctacgactacatcgagtccaagttcggggccgagaagctcaaggagtacatgacccgcgtgaaggacctgtaccagaagaagatcatcagcaaggccaagtaccagaagctgctcaagaaggagtccgagatcggcgacggcttcgtggagcgggacctgcgcgagacccagtacatcgcgaagaaggccaaggagatcctgctccagatcacccacaacgtcctgagcacgtccgggggcatcaccgaccggctgcgcaaggactgggggctcgtgaacgtgatgaaggagctgaacctgccgaagtaccgcgccctcggcctgaccaagatggaggaccggaagtacggccagcaggtcgaggtgatcaccgactggacgaagcgcaacgacctgcggcaccacgccatggacgccctcaccgtggcgttcaccaagcacaaccacatccagtacctgaactacctgaacgcccgcaagaacgagaagcacaaggagcacaacaacatcatggccatccagcagctcgagaccatcaaggtcacggacgagaacgggaacgagaagcggatcttcaaggcccccatgcccaacttccgccaggtggcgaagaccttcctggagaacgtgctgatcagccacaaggccaagaacaaggtcgtgaccaagaacaagaacaagatctccggcagcaacaaggtgcaggaggtcctcaccccgcgggggcagctgcacaaggagacggtgtacggcaagtaccagtactacgtgcagaaggaggagaagatcggggccaagttcgactccgagaccatcgagaaggtcgccaaccccctgtaccagagcctcctgaagaagcgcctggaggagaacggcggcgaccccaagaaggccttcaccgggaagaacagcctcgcgaagaaccccatctacctggacgacacccagacggagcagctgccggagaaggtgaagctcgtgtggctggagaactccttcagcatccggaaggacatcacccccgagaacttcaaggacgagaagctgatcgacaagatcctcgacgagggcgtcaagcgcatcctgaaggagcggctgcagtccttcgggaacgacgccaagaaggccttcagcgacctcgagaagaaccccatctggctgaacaaggagaagggcatcgccatcaagcgcgtgaccatctccggggtggccaacgcggagcccctgcacaccaagaaggaccacctcggcaaggagatcctggacaaggagggcaagccgatccccgtcgacttcatcagcacggggaacaaccaccacgtggccgtgtaccgggacgagaagggcaacctgcaggagaaggtcctctccgtgttcgaggccgtggtccgcgccaaccaggggctgcccatcatcgagaagacctacaaccagcacctgggctgggagttcctcttcagcatgaagcagaacgagatgttcgtgttccccaacgagtccaccgggttcaacccgaacgacatcgacctgctggaccccaagaacaagcggatcatcagccccaacctcttcaaggtgcagaagctggccaccaagaactacatgttcacgcaccacctggagaccaagtccatcgacggcgacatgctgaagaacaagaaggagctcagcggcatcctgtacaacttcatccagaccccgcagaagctgtacgggatcatcaaggtccgcatcaaccacctcggcgacatcgtgtccgtgggggagtactga

SEQ ID NO: 2189 - RNA, 4296 nt, synthetic construct
  misc_feature 1..4296: note = Cas9 variant
  source 1..4296: mol_type = other RNA
atgaagcgcatcctgggcctcgacctggggagctccagcatcggctgggccctggtgaacgaggccgagtccaagaacgagcggagctccatcgtcaagctcggggtgcgcgtgaaccccctgaccgtcgacgagagcatcaacttcgagaagggcaagtccatcaccacgaacgcggaccggaccctgaagcgcagcatgcggcgcaacctccaccggtacaagctgcgccgggaggccctgatcgaggtgctcaaggagtgcaagttcatcaccgaggacaccatcctgtccgagaacgggaaccgcacgaccttcgagacctaccggctgcgcgtgaaggccctcaccgaggagatcagcctggaggagttcgcccgggtcctgatcatgatcaacaagaagcgcggctacaagtccagccggaaggccggcggggcggaggaggacacgctcatcgacggcatggacatcgcccgcaagctgtacgacgccaacctgaccccgggggagctctgcctgcagctgctctccgccggcaagaaggtgctgcccgacttctaccggagcgacctgcagaacgagctcgaccgcatctgggagaagcagaaggagtactaccccgggatcctgaccgcggccctgaaggaggagctccggggcaagaagcgcgacgccgtgtgggccatctgcgccaacgcgttcgtctggaaggagacctacacggagtggaacaacgaggagtccaagaacgagcagatcgagaaggagcacaagctggagggcatctacagcaagcggaagcgcgacgaggccaagaaggagaacctgcagtggcgcgtgtccgggctcaaggagaagctgagcctggagcagctcgtgatcatcctgcaggagatcaacacccagatcaacaactccagcggctacctggggaccatcagcgaccggtccaaggagctctacttcaacaagcagaccgtcggccagtacctgatggacatcctggacaacaaccccaacgccagcctccgcaacatcgtgttctaccggcaggactacctggacgagttcaacgtgctgtgggagaagcaggccgagttccacaaggagctcacgggcgagctgaagaaggagatccgcgacatcatcatcttctaccagcggcgcctgaagtcccagaaggggctcatcagcttctgcgagttcgagtcccggcagatcgaggtcaagatcgacggcaagcgcaagatccggaccgtggggaaccgcgtgatcccgcggagcagccccctgttccaggagttcaagatctggcagatcctgaacaacatcgaggtcaccgccgtgggcaacaagaacaagcagcgcatgcagaacgggtccaacgagcccgacgacaccgagcagctcgagctgaacggccggcgctacctgtaccaggaggagaaggagctgctcgcgaaggagctgttcgtgcgggacaagatgacgaagctggacgtcctccgcctgctgttcgacaaccccgaggagctcgacctgaacttcaagaccatcgacggcaacaagaccgggtacctgttcttccaggcctactccaagatgatcgagatgagcggccacgagccggtggacttcaagaagcccatcgagaagatcgtggagcaggtcaagtccgtgttcgtcctcctgaactggaacaccgacatcctgagcttcgactccaacaaggagctcgacaagcagagctactacaagctgtggcacctcctctactccttcgagggggacaacacgcccaccggcaacgggtgcctggtgcagaagatcatggacagctacggcctgggcaaggagttcgccaagatcctcgccaacatcaccttccaggaggactacgggtccctgagcgccaaggcgatccacaagatcctgccccacctcaaggagggcaaccagtacgacgtggcctgcgagtacgccgggtaccggcactccaagagcagcctgaccaaggaggagatcgccaacaaggtcctgaaggacaagctcgaggtgctgccgcgcaactccctgcggaaccccgtggtcgagaagatcctcaaccagatggtgaacgtgatcaacgccatcatcgaggcgtacggccgccccgacgagatccgcgtcgagctggcccgggagctgaagaagaacgccaaggagcgcgagaagctcaccaagagcatcgccgagaccaccaagacccacgaggcgcacaagaagctgctgcaggaggagttcgggctcaagaacgtgggccggtccgacatcctgcgctacaagctgtacaaggagctcgagagccggggctacaagacgctgtactccaacacctacatcccccgcgagaagctgttcagcaaggagttcgacatcgagcacatcatcccgcaggcccggctgttcgacgactccttcagcaacaagaccctggaggcccgcaacgtgaacatcgagaaggggaaccggaccgcctacgacttcgtcaaggagaagttcggcgagtccgggacggacaacagcctggactgctacctcaacaacatcgaggtgctgttcgtgtccggcaagatcagcaagaccaagtacaccaagctgaagatgaccgagcaggacatccccggcgggttcatcgagcgcgacctccggaacacccagtacatcgccaagaaggcgctgtccatgctgaacgagatcagccgctgcgtcgtggccacgtccggcagcatcaccgacaagctccgggaggactggcagctggtggacgtcatgaaggagctgaactgggagaagtacaaggccctcgggctggtggagtacttcgaggacaaggacggcaagcagatcgggcgcatcaaggactggtccaagcggaacgaccaccgccaccacgccatggacgccctgaccgtggcgttcaccaaggaggtcttcatccagtacttcaacaacaagaacgccagcctcaaccccaacacgaacgagtacgccatcaagaacaagtacttccagaacggccgggccatcgcccccatcccgctgaacgagttccgcgcggaggccaagaagcacctggagaacaccctcatcagcatcaaggccaagaacaaggtgatcaccaacaacatcaacaagaccaagaagcggggcggggtgaacacgaagaagcagcagacgccccgcggccagctgcacctggagaccatctacgggtgctgccggcagtacctcaccaaggaggagaaggtcaacgcctccttcgacgtgagcaagatcgcgacggtgtccagctccgtctaccgcgacgccctgctgaagcgcctccaggagcaccacaacgaccccaagaaggccttcgccggccggaacagcctggacaagaagcccgtgtggctggacaaggagcagatccgcaaggtgccggagaaggtcaagaccgtgaccttcgagaccatctacacgatccggaaggagatctcccccgacctccgcgtggacaagatcatcgacagcggggtccggaagatgctgaccggccgcctgaaggagtacggcaacgacgccaagaaggcgttctccaacctcgacgagaagcccatctggctgaacaaggagaaggggatccccatcaagcgggtgaccatcagcggcatctccaacgcccagagcctgcacgtgaagaaggacaaggacgggaagccggtcctcgacggcaacgggcgcaacatccccgtggacttcgtgaacaccggcaacaaccaccacgtcgccgtgtaccggcgccccgtgatcgacaagaacggccagatggtcatcgacgagaacgggaacctgaagtacgagctggaggaggtggtggtcacgttcttcgacgccgtgacccgggtgaacctcggccagccgatcatcgacaaggactacaaggcctccgaggggtggcagttcctgttcagcatgaagcagaacgagtacttcgtcttccccaacaagaagaccggcttcaaccccaaggagatcgacctgctcgacgcggacaactacgggctgatctcccccaacctgttccgcgtgcagaagttcacccacaagaactacgtgttccggcaccacctcgagacgaccatcaaggacaccagctccatcctgcgcggcatcacctggatcgacttccggagctccaagggcctggacagcatcgtcaaggtgcgcgtcaaccacatcgggcagatcgtgagcgtgggcgagtactga

SEQ ID NO: 2190 - RNA, 4299 nt, synthetic construct
  misc_feature 1..4299: note = Cas9 variant
  source 1..4299: mol_type = other RNA
atgaagaagatcctgggcctcgacctggggagcaactccatcggctgggccctggtgaacgaggccgagaaccgcgacgaggcgagctccatcatcaagctcggggtccgggtgaaccccctgaccgtggacgagatgcagaacttcgagaagggcaagagcatcaccacgaacgccgaccgcaccctgaagcggtccatgcgccggaacctccagcgctacaagctgcggcgcgacgccctgatcaagctcctgaagaaggtcgggttcatcgccgacggcaccatcctgagcgagcagggcaaccggtccaccttcgagacgtaccgcctccgggccaaggcgccggacgaggagatcagcctgcaggagctggcccgcgtgctcctgatgatcaacaagaagcgggggtacaagtccagccgcaagatcaaggagaaggaggccggcaccctgatcgacgggatgaaggtggccaagaagctctacgacgaggacctgacccccggccagctgtgcctccagctgctggagtccgggaagaagtccctccccgacttctacagcagcgacctgcaggaggagttcgaccggatctggaacttccagaagcagttcaaccccaaggcgttctgcgacaccgccaaggaggagatcaagggcaagaacaagtcccagacgtgggccatcctggccaagtacttcatctggaccgacgagatggtcgtgtggaacgagaaggagagcaagaccgagcgcgtggagaaggagtgcaagctcgtcggcctgaagcggaccgtgaagaaggaggagcagcgcaaggagaactaccggtggcgcgtgcaggccctgacggagcagctcgacctggggaaggtcgcggtggtgctgcaggagatcaacggccagatctccaccagctccgggtacctcggcgccatcagcgaccggagcaaggtcctgtacttcaaccgccagaccgtgggccagtaccagatggccgagctggagaagaacccgaacacctccctccgcaacatggtgttctaccggcaggactacctggacgagttcgacaagatctgggagaagcaggccgagttccacaaggagctgacggtcgagctcaagaaggagatccgcgacatcatcatcttctaccagcggcgcctcaagagccagaaggggctgatcggcttctgcgagttcgagaaccgggagatcatggtggagaagaacgggaagatgcaggccaaggtggtcggctgcaaggtgatcccccgctcccaccccctcttccaggagttcaagatctggcagaccctgaacaacgtggaggtcttcgcgggggagaagaagtgcaagcggaagcgcaccgacgccttccccggcctgttcgacggcaccgaggacacgctcatggtggaggggtggcggtacctgtaccaggaggagaaggagatcctggccaaggagctcagcgtcaagaagtccctgaagaaggagtacatcctgaagctgctgttcgacaacccgcaggacctggacatgaacttcgagcagatcgagggcaacgacaccgggaacgtgctgttcagcgcctactccaagatgatcgagaagtacggctacgagcccctcgacttcggcaagagcaccgacgagatcatcgagcgcctccaggtgatcttcaccgacctggggtggaacacggacctgctgttcgtcgacctgaacaaggagggcaaggacctcgagaagcagccctacttcaagctgtggcacctcctgtactccttcgagggggacaacacccccaccggcaacgggaagctggtggagaagctgatggagctctgccacgtgggcaaggagtgcgccctggagctggtcaacatcagcttccagaacgactacgggtccctcagcgcgaaggccatcaagaagatcctgccgtacctgaaggagggcaaccggtacgacgtggcctgcggctacgccgggtaccgccactccaagagctccctcaccaaggaggagatcgagaacaaggtgctgaaggacaagctggacatcctccccaagaacagcctgcggaaccccgtcatcgagaagatcctgaaccagatggtgaacgtgatcaacgccatcatcgacacgtacggcaagcccgacgagatccgcgtcgagctcgcgcgggagctgaagaagtccgccaaggagcgcgacgagctgaccaaggccatcgccaagagcacccgggagcacgaggagatccgcaaggtgctccaggaggagttcgggatgatcaacgtgtcccggaacgacatcatccgctacaagctgtacgaggagctgaaggacaacggctacaagaccctctacagcaaccagtacatcccgaaggagaaggtcttcagcaaggagatcgacatcgagcacatcatcccccaggcgcgcctgttcgacgactccctgagcaacaagacgctcgagtacaaggccatcaacatcgagaagggcaacaagaccgcctacgacttcgtgaaggagaagtacggggagaagggcctgcagcagtacctgaaccggtgcgagtccctcttcaaggggcaccgcaccaagctgcggaagctgaagatgggccaggagaacatccccgaggggttcatcgaccgcgacctccggaacacccagtacatcgccaagaaggccctggcgatgctgaacgagatctgccgccgggtggtcgccacgaccggcagcatcaccgaccgcctccgggaggactggcagctggtggacgtgctgaaggagctcaacctgcccaagtacgagaccctgggcctcgtcgaggtgtacgaggacaaggacgggcgcaagatcaagcggatcaaggactggaccaagcgcaacgaccaccggcaccacgccatggacgccctgacggtggccttcaccaaggacgtcttcatccagtacttcaacaacaagaacgcggcctggcaggccgactgcaaggagcactccgacatcatcggcatcaagacccgctacttcgagaacgggcgggccctgccgcccatgcccctcgtgcgcttccgggccgaggccaagagccacctggagaccctgctcgtgtccatcaaggcgaagaacaaggtcgtgacgaacaacgtgaactgcaccaagcgcaagggcggggagaacaagaagctgcagcagacgccccggggccagctgcacctcgagaccatctacggcagccaccgccagtacgtcatgaaggaggagaaggtgaacgcctccttcgacagctccaagatcgccaccgtgtgcaagcaggcgtaccggaacgccctgctggagcgcctcgccgccttcgggaacgacccgaagaaggccttcaccggcaagaacagcctggagaagaaccccgtctacctggaccgcgagcagaccgcgcgggtgcccgagcgcgtgcggaccgtcgagctcgagacggtgtacaccatccgcaagcccgtggacccgaacctgtccgtcgacaaggtggtggacgccaaggtccggagcatcctggagcagcgcctccgggagtacgacggggaggccaagcgcgccttcgtgaacctggacgagaaccccatctggctgaacgaggagaagggcatcgccatcaagcgggtgaccatccgcgggatcaacaaggtccagtccctccacggcaagaaggacaagaacggcaacctgatcctggacgagaccgggaagaagatccccgtggacttcgtgaacacgggcaacaaccaccacgtcgcgatctaccggaagccggtgctcgacaagaccgggcaggagatgctggacaacgagggcaaccccgtgtacgagctggacgaggtcgtggtcagcttcttcgaggccgtgacccgcgtgaacctcgggctgcccgtcatcgacaagaactacaacaagtccgagggctggcagttcatgttcaccatgaagcagaacgagtacttcgtgttccccaacgagaagacgggcttcgacccgaaggaggtggacctgctcaaccccgagaactacgccgtcatcagccccaacctgttccgggtgcagaagatcaccgagaaggactacatgttccgccaccacctggagaccaaggtggtcgacgacaagttcctcaaggagatcacctggaagcggatcctgacgcccaacaagctggaggggatcgtgaaggtgcgcgtcaaccacatcggccagatcgtgagcgtgggggagtactga

SEQ ID NO: 2191 - RNA, 4299 nt, synthetic construct
  misc_feature 1..4299: note = Cas9 variant
  source 1..4299: mol_type = other RNA
atgaagaagatcctgggcctcgacctggggagcaactccatcggctgggccctggtgaacgaggccgagaacagcgacgaggtctccagcatcatcaagctcggggtgcgcgtgaaccccctgaccgtcgacgagatgcagaacttcgagaagggcaagtccatcaccacgaacgcggaccggaccctgaagcgcagcatgcggcgcaacctccagcggtacaagctgcgccgggacgccctgatcaagctcctgaagaaggtggggttcatcaccgacggcaccatcctgtccgagcagggcaaccgcacgaccttcgagacctaccggctccgcgccaaggccccggacgaggagatcagcctgcaggagctggcccgggtgctcctgatgatcaacaagaagcgcgggtacaagtccagccggaagatcaaggagaaggaggcgggcaccctgatcgacgggatggaggtcgccaagaagctctacgacgaggacctgacgcccggccagctgtgcctccagctgctggagtccgggaagaagtccctccccgacttctacagcagcgacctgcaggaggagttcgaccgcatctggaacttccagaagcagttcaaccccaaggccttctgcgacaccgccaaggaggagatcaagggcaagaacaagtcccagacctgggcgatcctggccaagtacttcatctggaccgacgagatggtggtgtggaacgagaaggagagcaagacggagcgggtcgagaaggagtgcaagctcgtgggcctgaagcgcaccgtgaagaaggaggagcagcggaaggagaactactgctggcgcgtccaggccctgaccgagcagctcgacctggagaaggtggccgtggtcctgcaggagatcaacgggcagatctccaccagctccggctacctcggggccatcagcgaccggagcaaggtgctgtacttcaaccgccagacggtgggccagtaccagatggcggagctggagaagaacccgaacacctccctccggaacatggtcttctaccgccaggactacctggacgagttcgacaagatctgggagaagcaggccgagttccacaaggagctgaccgtggagctcaagaaggagatccgcgacatcatcatcttctaccagcggcgcctcaagagccagaagggcctgatcgggttctgcgagttcgagaaccgggagatcatggtggagaagaacggcaagatgcaggccaaggtcgtggggtgcaaggtgatcccccgctcccaccccctcttccaggagttcaagatctggcagaccctgaacaacgtcgaggtgttcgccggcgagaagaagtgcaagcggaagcgcacggacgccttccccgggctgttcgacggcaccgaggacaccctcatggtcgagggctggcggtacctgtaccaggaggagaaggagatcctggcgaaggagctcagcgtgaagaagtccctgaagaaggagtacatcctgaagctgctgttcgacaacccgcaggacctggacatgaacttcgagcagatcgaggggaacgacaccggcaacgtgctgttcagcgcctactccaagatgatcgagaagtacgggtacgagcccctcgacttcggcaagcccacggacaagatcatcgagcagctgcaggtcatcttcgccgacctggggtggaacaccgacctcctgttcgtggacctgaacaaggagggcaaggacctcgagaagcagccctacttcaagctgtggcacctcctgtacagcttcgagggcgacaacaccccgaccgggaacggcaagctggtggagaagctgatggagctctgccacgtcgggaaggagtgcgccctggagctggtgaacatctccttccagaacgactacggcagcctctccgccaaggcgatcaagaagatcctgccctacctgaaggaggggaaccgctacgacgtggcctgcggctacgccggctaccggcacagcaagtccagcctcacgaaggaggagatcgagaacaaggtcctgaaggacaagctggacatcctccccaagaactccctgcgcaaccccgtggtggagaagatcctgaaccagatggtcaacgtgatcaacgccatcatcgacacctacgggaagccggacgagatccgggtggagctcgcccgcgagctgaagaagtccgcgaaggagcgggaggagctgaccaaggccatcgccaagagcacccgcgagcacgaggagatccggaaggtcctccaggaggagttcggcatgatcaacgtgagccgcaacgacatcatccggtacaagctgtacgaggagctgaaggacaacgggtacaagacgctctactccaaccagtacatccccaaggagaaggtgttcagcaaggagatcgacatcgagcacatcatcccccaggcccgcctgttcgacgacagcctgtccaacaagaccctcgagtacaaggcgatcaacatcgagaagggcaacaagaccgcctacgacttcgtcaaggagaagtacggcgagaaggggctgcagcagtacctgaaccggtgcgagagcctcttcaagggccagcgcaccaagctgcgcaagctgaagatggggcaggagaacatccccgagggcttcatcgaccgggacctccgcaacacgcagtacatcgccaagaaggccctggccatgctgaacgagatctgccggcgcgtggtggcgaccaccgggtccatcaccgaccggctccgcgaggactggcagctggtcgacgtgctgaaggagctcaacctgccgaagtacgagaccctgggcctcgtggaggtctacgaggacaaggacggccggaagatcaagcgcatcaaggactggacgaagcggaacgaccaccgccaccacgccatggacgccctgaccgtggccttcaccaaggacgtgttcatccagtacttcaacaacaagaacgccgcgtggcaggccgactgcaaggagcacagcgacatcatcgggatcaagacccggtacttcgagaacggccgctccctgccgcccatgcccctcgtccggttccgcgccgaggccaagagccacctggagacgctgctcgtgtccatcaaggccaagaacaaggtggtcaccaacaacgtgaactgcaccaagcggaagggcggggagaacaagaagctgcagcagagcccccgcgggcagctgcacctcgagaccatctacggctcccaccggcagtacgtgacgaaggaggagaaggtcaacgcgagcttcgactccagcaagatcgccaccgtgtgcaagcaggcctaccgcaacgccctgctggagcggctcgcggccttcggcaacgaccccaagaaggccttcaccgggaagaactccctggagaagaaccccgtgtacctgaaccgcgagcagaccgcccgggtccccgagcgcgtgcgcacggtggagctcgagaccgtctacaccatccggaagccggtggaccccaacctgagcgtggacaaggtcgtggacgccaaggtgcgctccatcctggagcagcggctccgcgagtacgacggcgaggcgaagcgggccttcgtcaacctggacgagaaccccatctggctgaacgaggagaaggggatcgccatcaagcgcgtgaccatccggggcatcaacaaggtgcagagcctccacgggaagaaggacaagaacggcaacctgatcctggacgagacgggcaagaagatcccggtcgacttcgtgaacaccgggaacaaccaccacgtggccatctaccgcaagcccgtcctcaacaagaccggccaggagatgctggacaacgaggggaaccccgtgtacgagctggacgaggtcgtggtgtccttcttcgaggccgtcacccgggtgaacctcggcctgcccgtgatcgacaagaactacaacaagagcgaggggtggcagttcatgttcacgatgaagcagaacgagtacttcgtcttcccgaacgagaagacccgcttcgaccccaaggaggtggacctgctcaaccccgagaactacgcggtgatcagccccaacctgttccgggtccagaagatcaccgagaaggactacatgttccgccaccacctggagaccaaggtggtggacgacaagttcctcaaggagatcacgtggaagcggatcctgaccccgaacaagctggagggcatcgtcaaggtgcgcgtgaaccacatcggccagatcgtctccgtgggggagtactga

SEQ ID NO: 2192 - RNA, 4299 nt, synthetic construct
  misc_feature 1..4299: note = Cas9 variant
  source 1..4299: mol_type = other RNA
atgaagaacatcctgggcctcgacctggggaccaccagcatcggcttcgcccacatcgtggaggacgagaacaaggagaagtccgagatcaaggagctgggggtccgcatcgtgagcctcacgaccgacgagcagtccgacttcgagaagggcaagagcatcaccaccaacgccaaccggacgctgaagcacggggcgcgcctgaacctcgaccggtaccagcagcgccggaagtacctgatcgacctgctccacaaggccaacctgatcaccccctccagcatcctggccgagaacggcaagaacaccacccactccacgtggcagctccgcgccaaggccgtgaccgagcggatcgagaaggaggagttcgcgcgcatcctgctggccatcaacaagaagcggggctacaagagctcccgcaaggccaagaccgaggacgaggggcaggccatcgacggcatggcgatcgccaagcggctctacgacgagaacctgaccccggggcagctgagcctccagctgctgcagcagaacaagaagctcctgcccgacttctaccgctccgacctgcagaaggagttcgacctcgtctggaacttccagaagcagttctaccccgacatcctgacggacatcttctacaaggagctgcagggcaaggggaaggacgccaccagcaaggccttctccaagcggtaccacttcgacaccgccgagaacaagggcagcaaggagtccgtgcgcctccaggcgtaccagtggcgggccgaggccgtgagcaagcagctgtccaaggaggaggtcgcctacgtgctgaccgagatcaacaacaacctcaacaacgccagcggctacctgggggcgatctccgaccgcagcaaggagctgtacttcaaccggcagacggtgggccagtacctctacgcccagctgcaggagaaccgccacaacagcctgaagaacaaggtcttctaccggcaggactacctcgacgagttcgagcgcatctgggagacccaggccctgttccacaaggagctgaccgacgagctcaagaagcagatccgggacgtggtgatcttctaccagcgcaagcccaagtcccagaaggggctgatcagcttctgcgagttcgagtccaaggagatcgagatcgagaaggacggcaagaccatcacgaagaacatcggcgcccgcgtcgtgcccaagagctccccgctgttccaggagttcaagatctggcagatcctcaacaacgtgatctgcaagcggaaggggatccgcaagaagaagatcagcgccaagaccacccagctggacctgctcaacgagtccagccagaccatcttctccctggacatggagtgcaagcagctgctgttcgacgagctgaacctgaagggcgacctcaagagcgacaaggtcctcaagctgctggggtacagcccccaggagtgggagatcaactacaaccagctcgagggcaaccggacgcagaaggcgctgtacgaggcctacctgaagatcgtggagatggaggcccacgacgtgaaggacatcctccagatcaagagcaccaaggacgactggtccctggacgagagccccctgtccgccagcgagatccgcgagtccgtcaaggccatcttccaggcgctcgggatctgcaccaagatcctgtacttcgacccgctgctccccgtgaaggacttcgaggagcaggacagctaccagctgtggcacctcctctactcctacgagagcgacgacagcacctccggcaacgagacgctgtaccggatcctggagaagaagtacgccttcaagcgcgagcacgcccggatcctcgccaacgtggcgctgcaggacgactacggcagcctgtccaccaaggccatccgcaagatctaccccaacatcaaggagaaccagtacagcaccgcctgcgagatggccgggtacaagcactccaagctcagcctgaccacggaggagctggaggcccgggagctcaagaacatcatccccctgctgaagaagaacgcgctccgcaacccggtcgtggagaagatcctgaaccagatgatcaacgtggtcaacgccctgatcgagaagaactccgagcgggacgccgagggcaagatcaccaagtacttccacttcgacgagatccgcatcgagctcgcccgggagctgaagaagaacgcccagaagcgctacgagatgacccagaacatcaacaaggcgaagtccgagcaccagaagatctccgagatcctgcagaaggagttcgggatcaagaaccccaccaagagcgacatcatccggtaccgcctctacaaggagctggagcacaacggctacaaggagctgtacacgaacacctacatcgcccccgacgtgctgttctccaagaacatcgacatcgagcacatcgtccccaaggcccgggtgttcgacgacagcttctccaacaagaccctggccttcaaggacttcaacatcaagaagggggagagcaccgccttcgactacatcacctccctgaagaacgaggagaagctcaaccagtacctggcgcgcgtggagaacgcctacaagacgaagaacatcagcccggccaagtacaagaacctgctcaagaaggcctccgagatcggcgacggcttcatcaaccgggacctgcgcgacacccagtacatcgcgaagaaggccaaggagatcctgttccaggtcaccaagaacgtgctcagcaccagcgggtccatcacggaccgcctgcgggaggactggagcctggtggacgtcatgaaggagctcaacatgcccaagtaccagtccctgggcctgaccgaggtggaggagcgcaaggacgggaacaaggtgaccgtcatcaaggactggaccaagcggaacgaccaccgccaccacgccatggacgccctcacggtggccttcaccaagcccagctacatccagtacctgaaccacctgaacgcgcggaaggacgagaacaacaagaactactccgtgatcctcgccatcgagaagaaggagaccatcaaggtccccaccaacaacggcaagaacaagcgcgtgttcatcgagccgatccccaacttccgccaggtggccaagaagcacctggaggagatcttcatcagccacaaggccaagaacaaggtcgtgacgaagaacaccaacaagcccgccgggaccaacaagcagcagatcaccctgacgccccggggccagctccacaaggagaccatctacggcaagtaccagtactacgtgaacaaggaggagaaggtcggggtgaagttcgacaaggagaccatcgcgaaggtgtccaacccgctgtaccgggaggccctgctcaagcgcctgcaggccaacgacaacgaccccaagaaggccttcaccggcaagaacgccctgagcaagaaccccatctacctcgacgaggcgaagacgaagaccctgcccgagaaggtcaacctgacctacctcgaggaggacttctccgtgcggaagaagatcgtgccgaagaaccccaccagcaaggagttcgtccccaacctgaagtccatcgagaaggtggtggacgagggggtccgcaacatcctgatcgagcggctccgcgtgtacaacaacgacccggagaaggccttcgtggacctggagaagaaccccatctggctgaacaaggagaagggcatcgccatcaagcgggtcacgatcagcggcgtgaacaacgcccagcccctccacatcgggaaggaccacctgggcaagaccaccctgaacaaggaggggaaggagatccccgtggactacgtctccaccggcaacaaccaccacgtggcgatctaccgcgacaaggaggggaacctccaggagcagatcgtgagcttcttcgaggccgtcgtgcggacgcagcagggcctgccgatcatcgacaagacctacaagcaggaggagggctggcagttcctgttcaccatgaagcagaacgagatgttcgtgttccccaacgaggccaccgggttcaaccccgccgagatcgacctcctggaccccaagaacaagaagcagatctccccgaacctgttccgcgtccagaagatcgccacgaaggactacttcttccggcaccacctcgagaccaacgtggagaccgacaacgtgctgaagaacaccacgtggaagcgcgagggcctgagcgggctcaaggacatcgtcaaggtgcggatcaaccacctgggcgacatcgtgtccatcggggagtactga

SEQ ID NO: 2193 - RNA, 4302 nt, synthetic construct
  misc_feature 1..4302: note = Cas9 variant
  source 1..4302: mol_type = other RNA
atgaagaagatcctgggcctggacctggggaccaccagcatcggctacgcccaggtgaacgagtccgaggacttcaaggacagctccatcgagcgcatcggggtccgggtgaaccccctgagcgtggacgagcagacgaacttcgagaagggcaagccgatctccatcaacgccgaccgcaccctcaagagcggggcgcggcgcaccctggaccggtaccaggaccgccggtccaacctgatcgacgccctcgtcaagagcgtgatcatcaccgaggacacggtgctggccgaggacggcaagaacaccacccactccaccttcgccctgcgcgccaagagcgcgtccgagaaggtcgagaaggccgagttcgcccggatcctcctggccatcaacaagaagcgcggctacaagagctcccggaagacgaacaacaacgacgacgaggggcaggcgatcgacggcatggccatcgccaagaagctgtacgacgagaacctcacccccgggcagctggcctaccagctgctcaaggagggcaagaagtacctgcccgacttctaccgcagcgacctgcaggccgagttcgacaagatctggaccttccagaagcagttctaccccgagatcctcaccgacgagctgcagaaggagctggcggggaagggccagcgggccacgtccgccatcttctggaagaagtacgacttcaacaccgccgagaacaagggcacccgcgaggagaagaagctcaaggcctacgagtggcggagcacctccgtggacaagaagctgcagaaggaggaggtggcgtacgtcatcacggagatcaacaacaacctgaccaacagctccgggtacctcggcgccatcagcgaccgcagcaaggagctgtacttcaacaagcagaccgtggggcagtacctgttcaagcagatccagaagaacccgcacaccaagctcaagaaccaggtgttctaccggcaggactacttcgacgagttcgagatcatctgggagacgcaggccaagttccaccccgagctgaccgaggagctgaagaacaagatccgcgacatcatcatcttctaccagcggaagctcaagtcccagaagggcctgatcagcttctgcgagttcgagcgcaaggaggtcgagatcgagaagggcgggcggcgcatgaagaagaccatcggcctgaaggtggcccccaagtccagccccctcttccaggagttcaagatctggcaggtcctgaacaacgtgctgatccgcaagaaggggtccaagaagcggcgcgtgaaggagccggaccagctcaacctggtggagcaggagcaggaggtcatgttcttcgacatgcagaccaagcagacgctgttcgacgagctcaacgtgaagggcaacctgaaggccaagcggatcatcgagctgatcgggcaggacgcgaacgactgggagatcaactacagcgagatcgagggcaaccgcaccaacaaggccctctacgacgcctacctgaagatcctggacctcgagggctacgacaccaaggccctgctggacgtgaagacctccaaggacgaggtcgagctcgacgacatcaacatcagcgggcccgaggtgaaggacctggtgaagcggatcttcgagtccctggagatcgacacgcagatcctggagttcgacgccgagctcgacggcgaggtcttcgagaagcagagctcctacctgctgtggcacctcctgtacagctacgagggggacgactcccccagcggcaacgagaagctgtacaagctcctgaagcagaagttcgggttcaagaaggagcacgcgcagatcctggcctccatcaccctcagcgacgactacggctccctgagcgccaaggccatgcgcaagatctacccctacatccgggagcagaccttcgacaaggcggcctccctggccggctaccgccacagcgccagctccctcaccaaggaggagatcgccaaccggccgctgaaggacaagctggagctcatcaagaagaacagcctgcgcaaccccgtggtcgagaagatcctgaaccaggtggtgaacatcgtcaactccctcatcgaggcgaacagcgagaaggactccgacgggaacatcatcagctacttcaagttcgacgagatccggatcgagctggcccgcgacctgaagaagaacgccaaggagcgggccgagatgacgctcaacatcaacgccgcgaagatcgtgcacgagaagatcttcaagctgctgcaggccgagttcggcgtgaagaaccccacccgcaacgacatcatccggtacaagctctacgaggagctgaagaacaacgggtacaaggacctgtacaccaacatctacatcccccgcgagatcctcttctccaagcagatcgacatcgagcacatcatcccgcagagcaagatgttcgacgactccttcagcaacaagaccatcgtcttccggaaggacaacctggacaagggcaactccacggccttcgactacatcgacagccgcttcgggaaggacaagctgaccgacttcgagcagcggatcgagttcctcttcgagcagggcaagaagaacaaggaggagggcatctccaaggccaagtaccagaagctgctgaagcgcgaggccgacatcggggacggcttcatcgagcgcgacctccgggacacccagtacatcgcgaagaaggcccgcaacctgctgtacgagatctgccggatcgtgacccccaccacggggagcatcaccgaccgcctccgggaggactgggacctggtgaacatcatgcaggagctgaacctcgacaagttcaagaagctgggcctgaccgagatggtcgagaagaaggacggctccttcaaggagcgcatcgtggactggagcaagcggaacgaccaccgccaccacgccatggacgccctcaccatcgcgttcacgaagcactcccacatccagtacctgaactacctgaacgcccggaagaacgagaaccacaagcagcaccacaacatcatcgggatcgagcgcaaggagaccgagttcgtgatcgacgacctcggcaacaagaagcggaagttccacctccccctgcccaacttccgcgaggaggccaagaagcacctggagaacgtcctggtgagcttcaaggccaagaacaaggtggtcaccaagaacaagaacaagaccgccagctccaagggggagaagatcaaggtggagctgacgccgcggggccagctccacaaggagaccgtgtacgggaagtacaagttctacgtcagcaaggaggagcgcatcggcggcaagttcgaccagcggaccatcgagcgcgtggcgaactccacccacaagcggctgctgctccagcgcctgctggagaacgacaacgacgccaagaaggccttcacggggaagaacgccctcgccaagaaccccatctacctggacgacaccaagaccctgaccctccccgagatcgtgaagctgacgtggctggaggaggactacagcatccggaaggacatcacccccgagaacttcaaggacatcaaggtcatcgacaagatcctcgacgagggcgtgaagcgcatcctgaaggagcggctggcgaagcacaacaacaacccgaaggaggccttctccgacctcgagaagaaccccatctggctgaacgagaagaagtccatcagcatcaagaaggtgaagatcagcgggatcaacaacgccgaggccctgcactacaagaagaaccacctcggcatcgagatcctggacgacgagaagaagcgcatccccgtcgacttcgtgtccaccgggaacaaccaccacgtggccatctaccgcgacgagaagggcaacctgcaggaggacgtcgtgagcttcttcgaggcggtggcccgggtcaaccagaacctccccatcatcgacaagaccctgaaggcctacctgggctggacgttcctcttcaccatgaagcagaacgagtacttcatcttcccgaacaagcagaccgggttcaaccccaccgagatcgacctgctggactccatgaacaacaagctcatcagccccaacctgttccgcgtgcagaagttcacggtgaaggactacttcttccggcaccacctggagaccaacgtcgaggacgactccaagctcaagaacaccacctggaagcgcgagggcctcgggggcatcgggaacatcgtgaaggtgcggatcaaccacatcggccagatcgtcaagatcggcgagtactga

SEQ ID NO: 2194 - RNA, 4305 nt, synthetic construct
  misc_feature 1..4305: note = Cas9 variant
  source 1..4305: mol_type = other RNA
atgaagaacatcctgggcctcgacctggggaccaacagcatcggctgggcctacgtgaagcaggcccagaacgactccgagaagtccgagatcgcggagctgggggtccgcgtgaaccccctcaccgtggacgagaagacgaacttcgagaagggcaagccgatcagcaccaacgccgaccggaccctgaagcgcggggcccggcgcaacctgcagcggtacaagctccgccggcaggagctgatcgagctgctcaaggactaccaggtcatcagcgacaagaccatcctggccgaggacggcaaggagacgaccttcgagaccctgcgcctccgggtgaagtccgccaaggagcaggtcagcctggaggagctggcgcgcatcctcctgatgatcaacaagaagcggggctacaagtccagccgcaaggccaagaacgaggacgaggggcagctgatcgacggcatggagatcgcccggcgcctctacgacgagaacctgaccacggggcagctgtccctccagctgctgaaggagggcaagaagtccctccccgactactaccggagcgacctgcagcacgagctggacaaggtgtggaacttccagaagcagttccaccccgacatcctcaccgacgagttctacaccagcatccaggggaagggccagaaggccacccgcgagtccttcagctccaagtacggcatcgacacggcggagaacaaggggagccgggaggagaagaagctgcaggcctaccagtggcgcgccgacgccacccacaaggagctgaccaaggaggagctcgccttcgtgatcaccgagatcaacaacaacatcaacaactccagcggctacctgggggcgatctccgaccggagcaaggagctgatcttcgccaacgagacggtgggcgagtacctctggaagcagatccagaacgacccccacaccagcctgaagaaccaggtcttctaccgccaggactacttcgacgagttcgagcggatctgggagacccagtccggcttctacccgcagatcctgaccgagagcctcaagaacgagctgcgcgacatcctgatcttctaccagcgcaagctcaagtcccagaaggccctggtgagcatctgcgagttcgagtccaaggagatccccctgaaggacaagcaggggaaccccatcagcaagaacggcatccccgtgacgaagctcgtcgggccgaaggtggcccccaagtccagccccctgttccaggagttcaagatctggcagaacctgaacaacgtgctcgtccggcccaagggctcccgcaagcggaaggtgaccaccaaccagcagagcaccctgctggaggggcaggagccggtgttcgagctcaacctggagcagaaggagctgctgttcgaggagctcaacctgaagggcaacctgaagacggactactgcctcgagctgatcggctactccgccaaggagtgggagatgaactaccccaccctggaggggaacaagaccaacaaggcgctctacgaggcctacctgaagatcatcgacagcgagggctacgacgccaagaagctgctcaaggtcaagaccgacaaggacgacatcaacctggacgacatcaaggtgtccgccagcgagatcaagacgatgatctccgacatcttcaacgagctggggatcaacaccaagatcctcgacttcgacgccgagctggagcgcaagcagttcgaggcgcaggccagctaccggctgtggcacctcctgtactcctacgagggcgacgacagcaagtccgggaacgagctgctctaccgcctgctggaggacaagttcggcttcaagcgggagcacagcaagaccctcgccaacgtgagcctgctgtccgactacggcaacctcagcaccaaggccatccgcacgatctacccctacatcaaggagaacaagttctccaccgcctgcgagctggcggggtaccggcacagcaagctgtccatcagcaaggaggagaacgagaaccgcaccctcaaggacaccctggacgtcctgaagaagaactccctccggcagcccgtggtggagaagatcctgaaccagatgatcaacctgatcaacgagctcatcgagaagcacagcgagaaggacgagaagggcaacatcgtcaagtacttcaagttcgacgagatccacatcgagctggcccgcgagctgaagaagaacgccgaggagcggcgcgagctcgactccaaggtgcgggaggggaaggaccgcaacgagaagatcatcacgatcctcaagagcgagttcggcctgccgtaccccaccaagaacgacatcacccggtaccgcctctacgaggagctgaaggacaacgggtacaaggacctgtacaccaacacctacatcccccgggagaagctgttctccaaggagatcgacatcgagcacatcatccccaagagccgcctgttcaacgactccttcagcaacaagacgatctgctaccgccaggacaacctgaacaagggcgagcggaccgcctacgactacatcgagggcctcgggaagacccagctggacgagtacctgaaccgcgtcgagaacctctacaccaacaagttcatcacgaaggcgaagtaccggaacctgctgaagaaggagtccgagatcggcgacgggttcatcgagcgcgacctccgggagacccagtacatcgccaagaaggccaaggagatgctgctgcagatcacccgccacgtggtgagcaccacgggctccatcaccgaccggctccgcgacgactgggagctggtcaacgtgatgcgggagctgaacctcccgaagtacaaggtgctgggcctgaccgagatccaggagcgcaagaacgggcagaccgtcgaggtgatcacggactggaccaagcggaacgaccaccgccaccacgccatggacgccctcaccgtggcgttcaccaagcacagccacatccagtacctgaacttcctgaacgcccggaaggacgagaagcacaaggagtacagcaacatcatgggcatccagcagctcgagacggagaagaccaccgacaaggacgggaaggaccgccgggtcttcaagacccccatccccaacttccgccaggtggccaaggagcacctggagtccatcctgatcagccacaagacgaagaacaaggtggtcacccgggccaccaacaagatcgccggctccaagaagcagcaggagaccctcagcccccgcgggcagctgcacaaggagacggtgtacggcaagtaccggcgctacgtgcagaaggaggagaagatcggctccaagttcgacctgcagaccatcgagcgggtcgcgaacccgctctacaagcgcctgctgaccaagcgcctcgaggagaacgggggcgaccccaagaaggccttcaccgggaagaacgccctggccaagagccccatctacctggacgagacgcagacccagcagctccccgagaaggtgaagctggtgtggctggagaccgacttctccatccggaaggacatcaccccggacaacttcaaggacgagaagtccatcgacaaggtcctcgacgagggcatcaagcgcatcctgaaggaccggctcaagagcttcgacggggacgccaagcgcgcgttcacggacctggagcagaaccccatctggctgaacaaggagaagggcatcgccatcaagcgggtgaccatcagcggcgtgtccaacgccgagcccctgcacaccaagaaggaccacctcgggaacgagatcttcgacgacaccggcaagccgatccccgtcgactacgtgagcacggggaacaaccaccacatcgccatctaccgcgacgagaacggcaacctgcaggagaaggcggtgtccttcttcgaggccgtcacccgggccaaccaggggctgcccaccgtggacaagacctacaaccagcacctcggctggcagttcctgttcaccatgaagcagaacgagatgttcgtgttccccaacaaggagacgggcttcgacccgcaggagatcgacctgctcgaccccaagaacaagaagctgatcagccccaacctgttccgcgtccagaagatctccaccaagaactacttcttccggcaccacctcgagaccagcgtggagacccacaacgccctgaacggggtgacgtacaagtcccagctgggcctgaacgggatcaccgacatcatcaaggtccgcatcaaccacctcggcgacatcgtgcacatcggggagtactga

SEQ ID NO: 2195 - RNA, 4308 nt, synthetic construct
  misc_feature 1..4308: note = Cas9 variant
  source 1..4308: mol_type = other RNA
atgctgggctgcgagcgcaagcggaagcgccgggagaaggagaagatggccaagcccaaggactacaccatcgggctcgacatcggcaccaacagcgtggggtgggtcgtgacggacgaccagaacaacatcctgcgcatcaagggcaagaaggccatcggggcgcggctgttcaccgagggcaaggtggccgccgagcgccggtccttccgcaccacccggcgccggctcagccgccggcgctggcggatcaagatgctggaggagctgttcgacgaggagatcgccaaggtcgacccgtccttcttcgcccgcctccacgagagctggatctcccccaaggacaagcggaagcgctacagcgcgatcgtgttcccctcccccgaggaggacaagaagttccacgagagctacccgacgatctaccacctccgggacaagctgatgaaggacgaccagaagcacgacatccgcgagatctacatcgccgtgcaccagatgatcaaggcccggggcaacttcctgcacgacgagtccgtcgagacctaccgcagcgggatgtccagcctgggcgggcgctccgagcggaacatcctgagcgtgcagaccctcgaggagctgaacgacctgttcgccgagaacgagggcaccgaggaggtggagctcaacgtcgcgtccgccgagcagatcaacgacatcctgaccgggggccacctgaacgccgacagccagaaggagatctccaacctcctgctgcccagctccttccccagcttcgacgacaaggccaaggagaagcaggtcaagaagctcatcaacaacgtggccacgaacatcagcaaggcgtggctgggctacaaggccgacttctccaccatcctgaacctcgccaaggtggacaaggaccagaagaagatcttcgccttcgccctgcagggcggggacgaggaggacaaggtgcaggagctggagagcctcctggagcagtcccagaccgacatcgtggaccgcctgatcgagatccggcacgcgatcgtcctcagcgagatcgtgcccgtggggatgacgctgtccgaggccatgatcgacaagtacgaccagcacaaggaggacctgatcaccctcaaggccgtcatccgcaacaccaaggacaagaagaaggccgccaagctgcaggcgatctacgacctgtacgtgaagaaccggcacgccgacctcgccaaggccatgaagctgaccggcatcaagaagcgcagcgagctgctcgacccggaggagctgaagaagggcatctccagcctgctcgacgactcccccgaggccgtggagatcaagcagcggctggaggagaagacgttcctgcccctccagcgcagcaacaacaacggggtcatccccaaccagctgcaccaggtggagctggacgagatcatcaagaagcagtccaagtactacccgttcctcgcggagaagaaccccgacgagagcgaggaggcccagaagaaggcccccaccaagctggacgccctgctgaccttccgggtgccctactacgtcggcccgatgatcaccaaggaggagcaggaggcgcagaacgggcactccttcgcctggatggtgcgccgggacccccaggaccacgaggccatcacgccctggaacttcgagaagaaggtcgacaagatggccagcgccacccagttcatcaagcgcatgaccaccaaggacacgtacctcctgggcgaggacgtgctgcccgcgtccagcctcaagtaccagctgttcaccgtgctgaacgagctcaacaacctgcgggtcaacgggaagaagctgacctccgacgagaaggagcaggtcatcgagggcctcttcaagaagcagaagaccgtgaaggccgacaagttcgtgaagtactggcaggccaagcacatcggcgccgacatcaaggtgaaggggctgagcgacccgtccaagttcaacagcacgatgagcacctacatcgacttcaagaagatcttcggcgaccagctgaacgacgtgaaccgccagaacgacttcgagaagatcatcgagtactccaccatcttcgaggaccggaagatcctcgaggacaagctgcgcgtcgacttcgcctggctgagcgaggagcagatcaagcagctctgccggctgcgcctgcaggggtggggccggctctccgacaagctgctgacccgcctcacggacgcggacgggcagaacgtgctggagcgcctgtggaacagcaacgacaacttcgtgcagatcgtctccgaccccaacatcaaggccaagatcgagcaggagaaccagaagctcctgcgggacagccagtccgacaacgccgtggagagcatcctggacgacgcctacaccagcccccagaacaagaaggccatccgccaggtgatgcgggtcgtgcacgacatcgtgaaggcgtgcgacggcaacgtccccgccaagttcgccatcgagttcgcccgcagccaggaggacgacccgaagcggaccaccgcgcgcgtgaaccagatgcagaagatctacgaccagatctccgacgaggtggtcagccagggcgtgaaggagcagctctccgggatgaagtccctgaaggaccggtactacctgtacttcatgcagggcgggcgcgacgcctacacgggcgccaagctcaacatcgaccggctgtccgactacgacgtggaccacatcatgccccagagcttcgtcaaggacgactccctggacaaccgcgtgctcgtggcccgggccgtcaacaaccagaagtccgacaaggtgcccgcgctgctgttcgggaacaaggtggtcgccgacctcggcatcaccgtgcgcgagatgtgggacaagtggcagaagctgggcatgatcagcaagcggaagctgagcaacctcctgaccgacagcgacgccctgaccgagtaccgcgcccaggggttcatccggcgccagctcgtggagacctcccaggtcatcaagctgacggccaccatcctgcagagcgagttccccgactccaagatcatcgaggtgccggcgaagtacaacagcatcgtgcggaagcagttcgacctctacaagtcccgcgaggtcaacgacttccaccacgccatcgacgcctacctgagcaccatcgtgggcaactacctgtaccaggtgtaccccaacctccggcgcatgttcgtctacggggagttcaagaagttctccagcaacgccgaggagtccgcccacgacgtggcgcggcgcgtcaagagcatgaacttcctggacgacctgctccgcggcacccacggcgacaacatctactgccggtccacgggggagatcgtgttcaaccgcaacgacatcatcagcaagctgaagcaggcctactccttcaagcagatgctggtgacccaggaggtgttcaccaagaagtccgccctcttcaaccagaccgtctaccccagcccgaagcgggacggcagcaagcgctccgggctgatcccccggaagcgcggcatggaccccgagatctacgggggctacgcccacaaccaggacagctacttcgtgctggcgaagatcgagaaggtgaagggctacacgctccagatcgtcggggtgcccatccggagcctggagatcatcaacaaggccgaggacttctccaccgccctgctcgacatcatcaagagcaaggtgatgtacaacgagaagaccggccagccgaagcgcgggatcaagaacgtcgagatcctggtgaacaagctgccctaccggcagcccatcctcgagaaggacgtctcctacatgctgggcagctccgcctacaagtacaacatcaagcagatcaccctgagccgccagtccatgaagtacatcctcgactacatcgacgaccccaacttcacgaagcacgagatgaccatgatcgacgagcagaacgagcgggagtgcctgctgagcgtgtacgacgagatcctcgagaaggtggacaagtacctgccgctgttcgacgggaacaagttccgcgagaagctccactccgcccggaaggagttcgtcagcctgtccgtggacgacgaggcgagcgccatcgagaagatcctgcgcggcctccacgccaactccgagatgcccagcctggagaacctgaagatcaagcccgccctcggcttcttccagatgaagaacgggatcaccctgtccaacgacgccgtgctgctctaccagagccccaccggcctgttcgagcggcgcgtcaaggtgtccgacctgctcaagtga

SEQ ID NO: 2196 - RNA, 4308 nt, synthetic construct
  misc_feature 1..4308: note = Cas9 variant
  source 1..4308: mol_type = other RNA
atgaagaacatcctgggcctcgacctggggaccaccagcatcggcttcgcccacatcgtggaggacgagaacaaggagaagtccgagatcaaggagctgggggtccgcatcgtgcccctcacgaccgacgagcagagcgacttcgagaagggcaagtccatcaccaccaacgccaaccggacgctgaagcacggggcgcgcctgaacctcgaccggtaccagcagcgccggaagtacctgatcgacctgctccagaaggccaacctgatcaccagctccagcatcctggccgagaacggcaagaacaccacccactccacgtggcagctccgcgccaaggccgtgaccgagcggatcgagaaggaggagttcgcgcgcgtcctgctggccatcaacaagaagcggggctacaagagctcccgcaaggccaagaccgaggacgaggggcaggccatcgacggcatggcgatcgccaagcggctctacgacgagaacctgaccacggggcagctgagcctccagctgctgcagcagaacaagaagctcctgccggacttctaccgctccgacctgcagaaggagttcgacctcgtgtggaacttccagaagcagttctaccccgacatcctgaccgacagcttctacaaggagctgcagggcaaggggaaggacgccacctccaaggccttcagcaagcggtaccacttcgacaccgccgagaacaagggctccaaggagagcgtgcgcctccaggcgtaccagtggcgggtcgaggccatctccaagcagctgagcaaggaggaggtggcctacgtgctgacggagatcaacaacaacctcaacaacgcctccggctacctgggggccatcagcgaccgcagcaaggagctgtacttcaaccggcagaccgtcggccagtacctctacgcgcagctgcaggagaaccgccacaactccctgaagaacaaggtgttctaccggcaggactacctcgacgagttcgagcgcatctgggagacccaggccagcttccacaaggagctgaccgaggagctgaagaagcagatccgggacgtggtcatcttctaccagcgcaagcccaagtcccagaaggggctcatcagcttctgcgagttcgagtccaaggagatcgagatcgagaaggacggcaagacgatcaccaagaccatcggcgcccgcgtggtgcccaagagctccccgctgttccaggagttcaagatctggcagatcctgaacaacgtcatctgcaagcggaaggggatccgcaagaagaaggtgagcgccaagaccacgcagctcgacctgctgaacgagtccagccagaccatcttctccctcgacatggagtgcaagcagctgctgttcgaggagctcaacctgaagggcgacctgaagtccgacaaggtgctgaagctcctggggtacagcccccaggagtgggagatcaactacaaccagctggagggcaaccggacccagaaggccctctacgaggcgtacctgaagatcgtcgagatggaggcccacgacgtgaaggacatcctgcagatcaagagcgccaaggacgactggtccctcgacgagagccccctgtccgccagcgagatccgcgagtccgtgaaggccatcttccaggcgctggggatctgcaccaagatcctctacttcgaccccctgctgccggtcaaggagttcgagaagcaggacagctaccagctctggcacctcctgtacagctacgagtccgacgacagcacgtccggcaacgagaccctctaccggatcctggagaagaagtacgccttcaagcgcgagcacgtgcggatcctggccaacgtggccctccaggacgactacggcagcctgtccaccaaggcgatccgcaagatctaccccaacatcaaggagaaccagtacagcatcgcctgcgagatggccgggtacaagcactccaagctgagcctcaccacggaggagctggaggcccgggagctgaagaacatcatccccctcctgaagaagaacgccctgcgcaaccccgtcgtggagaagatcctcaaccagatgatcaacgtcgtgaacgcgctgatcgagaagaactccgagcgggacgccgagggcaagatcaccaagtacttccacttcgacgagatccgcatcgagctggcccgggagctcaagaagaacgcccagaagcgctacgagatgacccagaacatcaacaaggccaagctggagcaccagaagatcagcgagatcctgcagaagcagttcgggatcaagaacccgaccaagtccgacatcatccggtaccgcctctaccaggagctggagcacaacggctacaaggagctgtacacgaacgcgtacatcgcccccgacgtgctgttcagcaagaacatcgacatcgagcacatcgtccccaaggcccgggtgttcgacgactccttcagcaacaagaccctggccttccgcgagttcaacatcaagaagggggagtccaccgccttcgactacatcaccagcctgaactccgaggaggagctcaaccagtacctgacccgggtggagaacgcgtacaagaccaagagcatcagccccaccaagtacaagaacctgctcaagaaggcctccgagatcggcgacgacttcatcaaccgcgacctgcgcgacacccagtacatcgccaagaaggccaaggagatcctgttccaggtcaccaagaacgtgctcagcacgtccggcagcatcaccgaccggctgcgcgaggactgggggctggtggacgtcatgaaggagctcaacatgccgaagtaccagtccctgggcctgaccgaggtggaggagcggaaggacgggaacaaggtgaccgtcatcaagaactggacgaagcgcaacgaccaccggcaccacgcgatggacgccctcaccgtggccttcaccaagcccagctacatccagtacctgaaccacctgaacgcccgcaaggacgagaacaacaagaactactccgtgatcctcgccatcgaggagaaggagaccatcaaggtccggacgaacaacggcaagaacaagcgcgtgttcatcgagcccatccccaacttccgccaggtggcgaagaagcacctggaggagatcttcatcagccacaagaccaagaacaaggtcgtgaccaagaacgtgaacaagccggccgggaccgacaagcagcagatcacgctgacgccccggggccagctccacaaggagaccatctacggcaagtaccagtactacgtcaacaaggaggagaagatcggggtgaagttcgacaaggagaccatcgccaaggtgtccaaccccctgtaccgggaggccctgctcaagcgcctgcaggccaacgacaacgaccccaagaaggcgttcacgggcaagaacgccctgagcaagaagccgatctacctcgacgagtccaagaccaagaccctgcccgagaaggtcaacctgacctacctcgaggaggacttcagcatccggaaggacatctcccccgacaacttcaaggacctcaagagcatcgagaaggtgatcgaccagggggtgaagcgcatcctgatcaagcggctgcaggcctacgacaacgaccccaagaaggccttcgtcgacctggagaagaacccgatctggctgaacaaggagaagggcatcgccatcaagcgcgtgacgatctccggcgtgaacaacgcgcagcccctccacatcgggaaggaccacctgggcaagaccaccctgaacaaggaggggaaggagatccccgtcgactacgtgagcaccggcaacaaccaccacgtggccatctaccgggacaaggaggggaacctccaggagcagatcgtctccttcttcgacgccgtggtgcgcgcccagcagggcctgccgatcatcgacaagacgtacaagcaggcggagggctggcagttcatgttcaccatgaagcagaacgagatgttcgtcttccccaacgagaccaccgggttcaaccccgccgagatcgacctgctcgaccccaagaacaagaagctgatcagcccgaacctgttccgggtgcagacgatctccgtggtcaagtacggcaacagcgtggtgcgcgacttcaagttccggcaccacctcgagaccaccctgcaggacgacaagatcctgcaggggatcaccttccagcagatcaagagcctcgagcccctgcgcaacatcgtcaaggtgcgcatcaaccacctgggcgacatcgtgtccatcggggagtactga

SEQ ID NO: 2197 - RNA, 4308 nt, synthetic construct
  misc_feature 1..4308: note = Cas9 variant
  source 1..4308: mol_type = other RNA
atgaagaacatcctgggcctcgacctggggaccaccagcatcggcttcgcccacatcgtggaggacgagaacaaggagaagtccgagatcaaggagctgggggtccgcatcgtgagcctcgccacggacgagcagtccgacttcgagaagggcaagagcatctccaccaacgcgaaccggaccctgaagcacggggcccgcctgaacctcgaccggtaccagcagcgccggaagttcctgatcgacctgctccagaaggccaacctgatcaccagcgcctccatcctggccgagaacggcaagaacacgacccacagcacctggcagctccgcgcgaaggccgtgaccgagcggatcgagaaggaggagttcgcccgcgtcctgctggccatcaacaagaagcggggctacaagaactcccgcaagacgaagaccgaggacgaggggcaggcgatcgacggcatggccatcgccaagtgcctctacgacgagaacctgacccccgggcagctgagcctccagctgctgcagcagaacaagaagctcctgccggacttctaccggtccgacctgcagaaggagttcgacctcgtgtggaacctgcagaagcagttctaccccgacatcctgaccgacagcttctacaaggagctccagggcaaggggaaggacgccacgtccaaggccttcagcaagcgctaccacttcgacaccgcggagaacaagggctccaaggagagcgtgcggctgcaggcctaccagtggcgcgccgaggccatctccaagcagctgagcaaggaggaggtcgcctacgtgctcaccgagatcaacaacaacctgaacaactccagcggctacctgggggcgatcagcgaccggtccaaggagctctacttcaaccgccagaccgtgggccagtacctgtacgcccagctgcaggagaaccggcacaacagcctcaagaacaaggtcttctaccgccaggactacctggacgagttcgagcggatctgggagacgcaggcctccttccacaaggagctgaccgacgagctcaagaagcagatccgcgacgtggtgatcttctaccagcggaagctcaagagccagaaggggctggtctccttctgcgagttcgagagcaaggagatcgagatcgagaaggacggcaaggccatcaccaagtccatcggcgcccgcgtggtgcccaagagcagccccctcttccaggagttcaagatctggcagatcctgaacaacgtcacgtgcaagcgcaaggggatccggaagaagaagtcctccgccaagagcacggagctggacctcttcaacgagccgtcccagagcatcttctccctggacatggagtgcaagcagctgctgttcgacgagctgaacctgaagggcgacctcaagagcgacaaggtgctgaagctgctggggtacagcccccaggagtgggagatcaactacaaccagctcgagggcaaccgcacccagaagtccctgtacgaggcgtacctgaagatcatcgagatcgaggggtacgaggtgaaggacatcctccagatcaagtccaccaaggacgactggagcctggacgagagccccctgtccgccagcgagatccgggagcgcgtcaaggtgatcttccagaccctcggcatctgcacgaagatcctgtacttcgaccccctgctcccggtgaaggagttcgagcagcagtactcctaccagctgtggcacctcctgtacagctacgagtccgacgacagcacctccggcaacgagaccctgtaccggatcctggagaagaagtacgccttcaagcgcgagcacgccaccatcctcgcgaacgtcgccctgcaggacgactacgggagcctgtccacgaaggccatccggaagatctacccctacatcaaggagaaccagtacagcaccgcctgcgagctcgcgggctacaagcactccaagctgagcctgaccaccgaggagctcgaggcccgcgagctgaagaacatcatccccctgctcaagaagaacgccctgcggaaccccgtggtggagaagatcctgaaccagatgatcaacgtcgtgaacgccctcatcgagaagaactccgagcgcgacgccgaggggaagatcacgaagtacttccacttcgacgagatccggatcgagctggcgcgcgagctgaagaagaacgcccaggagcggtacgagatgacccagaacatcaacaaggccaagctcgagcaccagaagatcagcgagaagctgcagaagcagttcggcatcaagaacccgaccaagtccgacatcatccgctaccggctgtaccaggagctcgagcacaacgggtacaaggagctgtacaccaacacgtacatcgcccccgacgtcctgttcagcaagaacatcgacatcgagcacatcgtgcccaaggcccgcgtgttcgacgactccttcagcaacaagaccctcgcgttcaaggagttcaacatcaagaagggcgagagcaccgccttcgactacatcacctccctgaactgcgagggcgagctgaaccagtacctcacccgggtcgagaacgcctacaagaccaagagcatctccctgaccaagtacaagaacctgctcaagaaggccagcgagatcggggacggcttcatcaaccgcgacctgcgggacacccagtacatcgccaagaaggcgaaggagatcctgttccaggtgaccaagaacgtgctctccacgagcgggtccatcaccgaccgcctgcgcgaggactggggcctggtcgacgtgatgaaggagctcaacatgcccaagtaccagagcctggggctgaccgaggtggaggagcggaaggacggcaacaaggtcaccgtgatcaaggactggacgaagcgcaacgaccaccggcaccacgccatggacgccctcaccgtggccttcaccaagccgtcctacatccagtacctgaaccacctgaacgcgcgcaaggacgagaacaacaagaactacagcgtcatcctcgccatcgagaagaaggagaccatcaaggtgcccatcaacaacggcaagaacaagcgggtgttcatcgagcccatcctgaacttccgccaggtcgccaagaagcacctggaggagatcttcatctcccacaaggccaagaacaaggtggtgacgaagaacatcaacaagcccgccgggaccgacaagcagcagatcaccctcaccccgcggggccagctgcacaaggagacgatctacgggaagtaccagtactacgtcaacaaggaggagaaggtgggcgtgaagttcgacgagcgcaccatcaccaaggtcagcaaccccctgtaccgggaggcgctcctgaagcgcctgcaggccaacgacaacgaccccaagaaggccttcgccggcaagaacgccctctccaagaaccccatctacctggacgaggcgaagaccaagacgctgccggagaaggtgaacctcacctacctggaggaggacttcagcatccggaaggacatctcccccgacaacttcaaggacctcaagagcatcgagaaggtgatcgaccagggggtcaagcgcatcctgatcaagcggctgcaggcctacgacaacgaccccaagaaggccttcgtggacctggagaagaaccccatctggctcaacaaggagaagggcatcgccatcaagcgcgtgaccatctccggggtcagcaacgcccagccgctgcacatcggcaaggaccacctggggaagaccacgctcaacaaggagggcaaggaggtgcccgtggactacgtctccaccggcaacaaccaccacgtggcgatctaccgggacaaggaggggaacctgcaggagcagatcgtgagcttcttcgaggccgtcgtgcgcgcccagcagggcctgcccatcatcgacaagaactacaagcaggccgaggggtggcagttcatgttcaccatgaagcagaacgagatgttcgtgttcccgaacgaggcgaccggcttcaaccccgccgagatcgacctcctggaccccaagaacaagaagctgatcagccccaacctcttccgggtccagacgatctccatcgtgaagtacgggaacagcgtggtccgcgacttcaagttccggcaccacctggagaccaccctgcaggacgacaagatcctccagggcatcaccttccagcagatcaagtccctggagccgctgcgcaacatcgtgaaggtgcggatcaaccacctcggcgacatcgtcaacatcggggagtactga

SEQ ID NO: 2198 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagaactacaccgagtggaacaaggagaagggcaagacggagcagcaggagcgggagcacaagctcgaggggatctactccaagcgcaagcgcgacgaggccaagcgggagaacctgcagtggcgcgtgaacggcctgaaggagaagctcagcctggagcagctggtcatcgtgttccaggagatgaacacccagatcaacaactccagcgggtacctcggcgccatctccgaccggagcaaggagctgtacttcaacaagcagaccgtgggccagtaccagatggagatgctggacaagaaccccaacgcctccctccgcaacatggtcttctaccggcaggactacctggacgagttcaacatgctgtgggagaagcaggccgtgtaccacaaggagctcaccgaggagctgaagaaggagatccgcgacatcatcatcttctaccagcggcgcctcaagagccagaaggggctgatcggcttctgcgagttcgagtcccggcagatcgaggtggacatcgacgggaagaagaagatcaagacggtcggcaaccgcgtgatcagccggtccagcccgctgttccaggagttcaagatctggcagatcctgaacaacatcgaggtgaccgtcgtggggaagaagcgcaagcggcgcaagctcaaggagaactacagcgcgctgttcgaggagctgaacgacgccgagcagctggagctcaacggctcccggcgcctgtgccaggaggagaaggagctgctcgcccaggagctgttcgtgcgggacaagatgaccaagagcgaggtcctgaagctcctgttcgacaacccccaggagctggacctcaacttcaagaccatcgacggcaacaagacggggtacgccctgttccaggcctactccaagatgatcgagatgagcggccacgagcccgtggacttcaagaagcccgtcgagaaggtggtggagtacatcaaggcggtcttcgacctgctcaactggaacaccgacatcctggggttcaactccaacgaggagctggacaaccagagctactacaagctctggcacctcctgtactccttcgagggcgacaacaccccgaccgggaacggccgcctgatccagaagatgacggagctgtacggcttcgagaaggagtacgccaccatcctggccaacgtgagcttccaggacgactacgggtccctcagcgccaaggccatccacaagatcctgccccacctgaaggagggcaaccggtacgacgtggcgtgcgtctacgccgggtaccgccactccgagagctccctcacccgcgaggagatcgccaacaaggtgctgaaggaccggctgatgctcctgcccaagaacagcctgcacaaccccgtggtcgagaagatcctcaaccagatggtgaacgtgatcaacgtcatcatcgacatctacggcaagccggacgagatccgcgtggagctggcccgggagctgaagaagaacgccaaggagcgcgaggagctcaccaagtccatcgcgcagacgaccaaggcccacgaggagtacaagaccctgctgcagaccgagttcgggctcacgaacgtgagccggaccgacatcctgcgctacaagctgtacaaggagctcgagtcctgcggctacaagaccctgtacagcaacacctacatctcccgggagaagctgttcagcaaggagttcgacatcgagcacatcatcccccaggcccgcctcttcgacgacagcttctccaacaagaccctggaggcccggagcgtcaacatcgagaagggcaacaacacggcgtacgacttcgtgaaggagaagttcggggagtccggcgccgacaacagcctggagcagtacctcaacaacatcgaggacctgttcaagtccgggaagatcagcaagaccaagtacaacaagctgaagatggccgagcaggacatccccgacggcttcatcgagcgcgacctccggaacacccagtacatcgccaagaaggccctgtccatgctgaacgagatcagccaccgcgtggtcgcgacctccggcagcgtgacggacaagctccgggaggactggcagctgatcgacgtgatgaaggagctgaactgggagaagtacaaggccctcgggctggtcgagtacttcgaggaccgcgacggccggcagatcgggcgcatcaaggactggaccaagcggaacgaccaccgccaccacgccatggacgccctgaccgtggccttcaccaaggacgtgttcatccagtacttcaacaacaagaacgcgtccctcgaccccaacgccaacgagcacgccatcaagaacaagtacttccagaacggccgggccatcgccccgatgcccctgcgcgagttccgggcggaggccaagaagcacctggagaacacgctcatcagcatcaaggccaagaacaaggtcatcaccgggaacatcaacaagacccgcaagaagggcggcgtgaacaagaacatgcagcagacgccccgcgggcagctgcacctggagaccatctacggctccgggaagcagtacctcaccaaggaggagaaggtgaacgccagcttcgacatgcggaagatcggcaccgtctccaagagcgcgtaccgcgacgccctgctgaagcggctctacgagaacgacaacgaccccaagaaggccttcgccgggaagaactccctggacaagcagccgatctggctggacaaggagcagatgcgcaaggtgcccgagaaggtgaagatcgtcaccctcgaggccatctacacgatccggaaggagatcagccccgacctgaaggtggacaaggtgatcgacgtcggcgtgcgcaagatcctgatcgaccggctcaacgagtacggcaacgacgcgaagaaggccttcagcaacctggacgagaaccccatctggctgaacaaggagaaggggatctccatcaagcgcgtgaccatcagcggcatctccaacgcccagagcctccacgtcaagaaggacaaggacgggaagccgatcctggacgagaacggccggaacatccccgtggacttcgtgaacaccgggaacaaccaccacgtcgccgtgtactaccgccccgtgatcgacaagcggggccagctggtcgtggacgaggccggcaaccccaagtacgagctcgaggaggtggtcgtgtccttcttcgaggcggtgacccgcgccaacctggggcagccgatcatcgacaaggactacaagacgaccgagggctggcagttcctgttcagcatgaagcagaacgagtacttcgtcttccccaacgagaagaccgggttcaaccccaaggagatcgacctcctggacgtggagaactacggcctgatctccccgaacctcttccgggtgcagaagttcagcctgaagaactacgtcttccgccaccacctggagaccacgatcaaggacacctccagcatcctccgggggatcacctggatcgacttccgctccagcaagggcctggacaccatcgtgaaggtccgggtgaaccacatcggccagatcgtgtccgtcggggagtactga

SEQ ID NO: 2199 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagaactacaccgagtggaacaaggagaagggcaagacggagcagcaggagcgggagcacaagctcgaggggatctactccaagcgcaagcgcgacgaggccaagcgggagaacctgcagtggcgcgtgaacggcctgaaggagaagctcagcctggagcagctggtcatcgtgttccaggagatgaacacccagatcaacaactccagcgggtacctcggcgccatctccgaccggagcaaggagctgtacttcaacaagcagaccgtgggccagtaccagatggagatgctggacaagaaccccaacgcctccctccgcaacatggtcttctaccggcaggactacctggacgagttcaacatgctgtgggagaagcaggccgtgtaccacaaggagctcaccgaggagctgaagaaggagatccgcgacatcatcatcttctaccagcggcgcctcaagagccagaaggggctgatcggcttctgcgagttcgagtcccggcagatcgaggtggacatcgacgggaagaagaagatcaagacggtcggcaaccgcgtgatcagccggtccagcccgctgttccaggagttcaagatctggcagatcctgaacaacatcgaggtgaccgtcgtggggaagaagcgcaagcggcgcaagctcaaggagaactacagcgcgctgttcgaggagctgaacgacgccgagcagctggagctcaacggctcccggcgcctgtgccaggaggagaaggagctgctcgcccaggagctgttcatccgggacaagatgaccaagagcgaggtgctgaagctcctgttcgacaacccccaggagctggacctcaacttcaagaccatcgacggcaacaagacggggtacgccctgttccaggcctactccaagatgatcgagatgagcggccacgagcccgtcgacttcaagaagcccgtggagaaggtcgtggagtacatcaaggcggtgttcgacctgctcaactggaacaccgacatcctggggttcaactccaacgaggagctggacaaccagccgtactacaagctctggcacctcctgtacagcttcgagggcgacaacacccccaccgggaacggccgcctgatccagaagatgacggagctgtacggcttcgagaaggagtacgccaccatcctggccaacgtctccttccaggacgactacgggagcctctccgccaaggccatccacaagatcctgccccacctgaaggagggcaaccggtacgacgtggcgtgcgtgtacgccgggtaccgccacagcgagtccagcctcacccgcgaggagatcgccaacaaggtcctgaaggaccggctgatgctcctgcccaagaactccctgcacaacccggtggtggagaagatcctcaaccagatggtcaacgtgatcaacgtgatcatcgacatctacggcaagcccgacgagatccgcgtcgagctggcccgggagctgaagaagaacgccaaggagcgcgaggagctcaccaagagcatcgcgcagacgaccaaggcccacgaggagtacaagaccctgctgcagaccgagttcgggctcacgaacgtgtcccggaccgacatcctgcgctacaagctgtacaaggagctcgagagctgcggctacaagaccctgtactccaacacctacatcagccgggagaagctgttctccaaggagttcgacatcgagcacatcatcccccaggcccgcctcttcgacgacagcttcagcaacaagaccctggaggcccggtccgtgaacatcgagaagggcaacaagacggcgtacgacttcgtcaaggagaagttcggggagagcggcgccgacaactccctggagcactacctcaacaacatcgaggacctgttcaagagcgggaagatctccaagaccaagtacaacaagctgaagatggccgagcaggacatccccgacggcttcatcgagcgcgacctccggaacacccagtacatcgccaagaaggccctgagcatgctgaacgagatctcccaccgcgtggtggcgaccagcggctccgtcacggacaagctccgggaggactggcagctgatcgacgtgatgaaggagctgaactgggagaagtacaaggccctcgggctggtggagtacttcgaggaccgcgacggccggcagatcgggcgcatcaaggactggaccaagcggaacgaccaccgccaccacgccatggacgccctgaccgtcgccttcaccaaggacgtgttcatccagtacttcaacaacaagaacgcgagcctcgacccgaacgccaacgagcacgccatcaagaacaagtacttccagaacggccgggccatcgcccccatgcccctgcgcgagttccgggcggaggccaagaagcacctggagaacacgctcatctccatcaaggccaagaacaaggtgatcaccgggaacatcaacaagacccgcaagaagggcggcgtcaacaagaacatgcagcagacgccccgcgggcagctgcacctggagaccatctacggcagcgggaagcagtacctcaccaaggaggagaaggtgaacgcctccttcgacatgcggaagatcggcaccgtgagcaagtccgcgtaccgcgacgccctgctgaagcggctctacgagaacgacaacgacccgaagaaggccttcgccgggaagaacagcctggacaagcagcccatctggctggacaaggagcagatgcgcaaggtccccgagaaggtgaagatcgtgaccctcgaggccatctacacgatccggaaggagatctcccccgacctgaaggtcgacaaggtgatcgacgtgggcgtccgcaagatcctgatcgaccggctcaacgagtacggcaacgacgcgaagaaggccttcagcaacctggacaagaacccgatctggctgaacaaggagaaggggatcagcatcaagcgcgtgaccatctccggcatcagcaacgcccagtccctccacgtgaagaaggacaaggacgggaagcccatcctggacgagaacggccggaacatccccgtcgacttcgtgaacaccgggaacaaccaccacgtggccgtctactaccgccccgtgatcgacaagcggggccagctggtggtcgacgaggccggcaacccgaagtacgagctcgaggaggtggtggtcagcttcttcgaggcggtgacccgcgccaacctggggctgcccatcatcgacaaggactacaagacgaccgagggctggcagttcctcttctccatgaagcagaacgagtacttcgtgttccccaacgagaagaccgggttcaacccgaaggagatcgacctgctggacgtcgagaactacggcctcatcagccccaacctgttccgggtgcagaagttctccctgaagaactacgtgttccgccaccacctcgagaccacgatcaaggacaccagctccatcctgcgggggatcacctggatcgacttccgcagctccaagggcctggacaccatcgtcaaggtgcgggtcaaccacatcggccagatcgtgagcgtgggggagtactga

SEQ ID NO: 2200 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagaactacaccgagtggaacaaggagaagggcaagacggagcagcaggagcgggagcacaagctcgaggggatctactccaagcgcaagcgcgacgaggccaagcgggagaacctgcagtggcgcgtgaacggcctgaaggagaagctcagcctggagcagctggtcatcgtgttccaggagatgaacacccagatcaacaactccagcgggtacctcggcgccatctccgaccggagcaaggagctgtacttcaacaagcagaccgtgggccagtaccagatggagatgctggacaagaaccccaacgcctccctccgcaacatggtcttctaccggcaggactacctggacgagttcaacatgctgtgggagaagcaggccgtgtaccacaaggagctcaccgaggagctgaagaaggagatccgcgacatcatcatcttctaccagcggcgcctcaagagccagaaggggctgatcggcttctgcgagttcgagtcccggcagatcgaggtggacatcgacgggaagaagaagatcaagacggtcggcaaccgcgtgatcagccggtccagcccgctgttccaggagttcaagatctggcagatcctgaacaacatcgaggtgaccgtcgtggggaagaagcgcaagcggcgcaagctcaaggagaactacagcgcgctgttcgaggagctgaacgacgccgagcagctggagctcaacggctcccggcgcctgtgccaggaggagaaggagctgctcgcccaggagctgttcatccgggacaagatgaccaagagcgaggtgctgaagctcctgttcgacaacccccaggagctggacctcaacttcaagaccatcgacggcaacaagacggggtacgccctgttccaggcctactccaagatgatcgagatgagcggccacgagcccgtcgacttcaagaagcccgtggagaaggtcgtggagtacatcaaggcggtgttcgacctgctcaactggaacaccgacatcctggggttcaactccaacgaggagctggacaaccagagctactacaagctctggcacctcctgtactccttcgagggcgacaacaccccgaccgggaacggccgcctgatccagaagatgacggagctgtacggcttcgagaaggagtacgccaccatcctggccaacgtcagcttccaggacgactacgggtccctcagcgccaaggccatccacaagatcctgccccacctgaaggagggcaaccggtacgacgtggcgtgcgtgtacgccgggtaccgccactccgagagctccctcacccgcgaggagatcgccaacaaggtcctgaaggaccggctgatgctcctgcccaagaacagcctgcacaaccccgtggtggagaagatcctcaaccagatggtcaacgtgatcaacgtgatcatcgacatctacggcaagccggacgagatccgcgtcgagctggcccgggagctgaagaagaacgccaaggagcgcgaggagctcaccaagtccatcgcgcagacgaccaaggcccacgaggagtacaagaccctgctgcagaccgagttcgggctcacgaacgtgagccggaccgacatcctgcgctacaagctgtacaaggagctcgagtcctgcggctacaagaccctgtacagcaacacctacatctcccgggagaagctgttcagcaaggagttcgacatcgagcacatcatcccccaggcccgcctcttcgacgacagcttctccaacaagaccctggaggcccggagcgtgaacatcgagaagggcaacaagacggcgtacgacttcgtcaaggagaagttcggggagtccggcgccgacaacagcctggagcactacctcaacaacatcgaggacctgttcaagtccgggaagatcagcaagaccaagtacaacaagctgaagatggccgagcaggacatccccgacggcttcatcgagcgcgacctccggaacacccagtacatcgccaagaaggccctgtccatgctgaacgagatcagccaccgcgtggtggcgacctccggcagcgtcacggacaagctccgggaggactggcagctgatcgacgtgatgaaggagctgaactgggagaagtacaaggccctcgggctggtggagtacttcgaggaccgcgacggccggcagatcgggcgcatcaaggactggaccaagcggaacgaccaccgccaccacgccatggacgccctgaccgtcgccttcaccaaggacgtgttcatccagtacttcaacaacaagaacgcgtccctcgaccccaacgccaacgagcacgccatcaagaacaagtacttccagaacggccgggccatcgccccgatgcccctgcgcgagttccgggcggaggccaagaagcacctggagaacacgctcatcagcatcaaggccaagaacaaggtgatcaccgggaacatcaacaagacccgcaagaagggcggcgtcaacaagaacatgcagcagacgccccgcgggcagctgcacctggagaccatctacggctccgggaagcagtacctcaccaaggaggagaaggtgaacgccagcttcgacatgcggaagatcggcaccgtgtccaagctggcgtaccgcgacgccctgctcaagcggctgtacgagaacgacaacgaccccaagaaggccttcgccgggaagaacagcctggacaagcagccgatctggctcgacaaggagcagatgcgcaaggtccccgagaaggtgaagatcgtgaccctggaggccatctacacgatccggaaggagatctcccccgacctgaaggtcgacaaggtgatcgacgtgggcgtccgcaagatcctcatcgaccggctgaacgagtacggcaacgacgcgaagaaggccttcagcaacctggacgagaaccccatctggctcaacaaggagaaggggatcagcatcaagcgcgtgaccatctccggcatcagcaacgcccagtccctgcacgtgaagaaggacaaggacgggaagccgatcctggacgagaacggccggaacatccccgtcgacttcgtgaacaccgggaacaaccaccacgtggccgtctactaccgccccgtgatcgacaagcggggccagctcgtggtcgacgaggccggcaaccccaagtacgagctggaggaggtggtggtcagcttcttcgaggcggtgacccgcgccaacctggggcagccgatcatcgacaaggactacaagacgaccgagggctggcagttcctcttctccatgaagcagaacgagtacttcgtgttccccaacgagaagaccgggttcaaccccaaggagatcgacctgctggacgtcgagaactacggcctcatcagcccgaacctgttccgggtgcagaagttctccctgaagaactacgtgttccgccaccacctcgagaccacgatcaaggacaccagctccatcctgcgggggatcacctggatcgacttccgcagctccaagggcctggacaccatcgtcaaggtgcgggtcaaccacatcggccagatcgtgagcgtgggggagtactga

SEQ ID NO: 2201 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagacctacacggagtggaacaaggagaagggcaagaccgagcagcaggagcgggagcacaagctcgaggggatctactccaagcgcaagcgcgacgaggccaagcgggagaacctgcagtggcgcgtgaacggcctgaaggagaagctcagcctggagcagctggtcatcgtgttccaggagatgaacacccagatcaacaactccagcgggtacctcggcgccatctccgaccggagcaaggagctgtacttcaacaagcagaccgtgggccagtaccagatggagatgctggacaagaaccccaacgcctccctccgcaacatggtcttctaccggcaggactacctggacgagttcaacatgctgtgggagaagcaggccgtgtaccacaaggagctcacggaggagctgaagaaggagatccgcgacatcatcatcttctaccagcggcgcctcaagagccagaaggggctcatcggcttctgcgagttcgagtcccggcagatcgaggtggacatcgacgggaagaagaagatcaagaccgtcggcaaccgcgtgatcagccggtccagcccgctgttccaggagttcaagatctggcagatcctgaacaacatcgaggtgaccgtcgtggggaagaagcgcaagcggcgcaagctcaaggagaactacagcgcgatcttcgaggagctgaacgacgccgagcagctggagctgaacggctcccggcgcctctgccaggaggagaaggagctgctggcccaggagctgttcgtgcgggacaagatgaccaagagcgaggtcctgaagctcctgttcgacaacccccaggagctggacctgaacttcaagacgatcgacggcaacaagaccgggtacgccctcttccaggcctactccaagatgatcgagatgagcggccacgagcccgtggacttcaagaagcccgtcgagaaggtggtggagtacatcaaggcggtcttcgacctgctgaactggaacaccgacatcctcgggttcaactccaacgaggagctggacaaccagagctactacaagctgtggcacctcctgtactccttcgagggcgacaacaccccgacggggaacggccgcctgatccagaagatgaccgagctctacggcttcgagaaggagtacgccaccatcctggccaacgtgagcttccaggacgactacgggtccctgagcgccaaggccatccacaagatcctcccccacctgaaggagggcaaccggtacgacgtggcgtgcgtctacgccgggtaccgccactccgagagctccctgacccgcgaggagatcgccaacaaggtgctcaaggaccggctgatgctgctccccaagaacagcctgcacaaccccgtggtcgagaagatcctgaaccagatggtgaacgtgatcaacgtcatcatcgacatctacggcaagccggacgagatccgcgtggagctcgcccgggagctgaagaagaacgccaaggagcgcgaggagctgacgaagtccatcgcgcagaccaccaaggccaacgaggagtacaagaccctcctgcagacggagttcgggctgaccaacgtgagccggaccgacatcctccgctacaagctgtacaaggagctggagtcctgcggctacaagaccctctacagcaacacctacatctcccgggagaagctgttcagcaaggagttcgacatcgagcacatcatcccccaggcccgcctgttcgacgacagcttctccaacaagacgctcgaggcccggagcgtcaacatcgagaagggcaacaagaccgcgtacgacttcgtgaaggagaagttcggggagtccggcgccgacaacagcctggagcactacctgaacaacatcgaggacctcttcaagtccgggaagatcagcaagaccaagtacaacaagctgaagatggccaagcaggacatccccgacggcttcatcgagcgcgacctgcggaacacccagtacatcgccaagaaggccctctccatgctgaacgagatcagccaccgcgtggtcgcgacgtccggcagcgtgaccgacaagctgcgggaggactggcagctcatcgacgtgatgaaggagctgaactgggagaagtacaaggccctggggctcgtcgagtacttcgaggaccgcgacggccggcagatcgggcgcatcaaggactggaccaagcggaacgaccaccgccaccacgccatggacgccctgaccgtggccttcacgaaggacgtgttcatccagtacttcaacaacaagaacgcgtccctggaccccaacgccaacgagcacgccatcaagaacaagtacttccagaacggccgggccatcgccccgatgcccctccgcgagttccgggcggaggccaagaagcacctggagaacaccctgatcagcatcaaggccaagaacaaggtcatcaccgggaacatcaacaagacccgcaagaagggcggcgtgaacaagaacatgcagcagacgccccgcgggcagctccacctggagaccatctacggctccgggaagcagtacctgaccaaggaggagcgggtgaacgccagcttcgacatgcgcaagatcgagaccgtctccaagagcgcgtaccgggacgccctcctgaagcgcctgtacgagaacgacaacgaccccaagaaggccttcgccggcaagaactccctcgacaagcagccgatctggctggacaaggagcagaagcggaaggtgcccgagaaggtgaagatcgtcacgctggaggccatctacaccatccgcaaggagatcagccccgacctcaaggtggacaaggtgatcgacgtcggggtgcggaagatcctgatcgaccgcctgaacgagtacggcaacgacgcgaagaaggccttcagcaacctcgacgagaaccccatctggctgaacaaggagaagggcatctccatcaagcgggtgaccatcagcgggatctccaacgcccagagcctgcacgtcaagaaggacaaggacggcaagccgatcctcgacgagaacgggcgcaacatccccgtggacttcgtgaacaccggcaacaaccaccacgtcgccgtgtactaccggcccgtgatcgacaagcgcgggcagctggtcgtggacgaggccggcaaccccaagtacgagctggaggaggtggtcgtgtccttcttcgaggcggtgacgcgggccaacctcggccagccgatcatcgacaaggactacaagaccaccgaggggtggcagttcctgttcagcatgaagcagaacgagtacttcgtcttccccaacgagaagaccggcttcaaccccaaggagatcgacctgctcgacgtggagaactacgggctgatctccccgaacctgttccgcgtgcagaagttcagcctcaagaactacgtcttccggcaccacctggagacgaccatcaaggacacctccagcatcctgcgcggcatcacctggatcgacttccggtccagcaaggggctcgacacgatcgtgaaggtccgcgtgaaccacatcggccagatcgtgtccgtcggcgagtactga

SEQ ID NO: 2202 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagacctacacggagtggaacaaggagaagggcaagaccgagcagcaggagaaggagcacaagctcgaggggatctactccaagcggaagcgcgacgaggccaagcgcgagaacctgcagtggcgggtgaacggcctgaaggagaagctcagcctggagcagctggtcatcgtgttccaggagatgaacacccagatcaacaactccagcgggtacctcggcgccatctccgaccgcagcaaggagctgtacttcaacaagcagaccgtgggccagtaccagatggagatgctggacaagaaccccaacgcctccctccggaacatggtcttctaccgccaggactacctggacgagttcaacatgctgtgggagaagcaggccgtgtaccacaaggagctcacggaggagctgaagaaggagatccgggacatcatcatcttctaccagcgccggctcaagagccagaaggggctcatcggcttctgcgagttcgagtcccgccagatcgaggtggacatcgacgggaagaagaagatcaagaccgtcggcaaccgggtgatcagccgctccagcccgctgttccaggagttcaagatctggcagatcctgaacaacatcgaggtgaccgtcgtggggaagaagcggaagcgccggaagctcaaggagaactacagcgcgctgttcgaggagctgaacgacgccgagcagctggagctcaacggctcccgccggctgtgccaggaggagaaggagctgctcgcccaggagctgttcatccgcgacaagatgaccaagagcgaggtgctgaagctcctgttcgacaacccccaggagctggacctcaacttcaagacgatcgacggcaacaagaccgggtacgccctgttccaggcctactccaagatgatcgagatgagcggccacgagcccgtcgacttcaagaagcccgtggagaaggtcgtggagtacatcaaggcggtgttcgacctgctcaactggaacaccgacatcctggggttcaactccaacgaggagctggacaaccagagctactacaagctctggcacctcctgtactccttcgagggcgacaacaccccgacggggaacggccggctgatccagaagatgaccgagctgtacggcttcgagaaggagtacgccaccatcctggccaacgtcagcttccaggacgactacgggtccctcagcgccaaggccatccacaagatcctgccccacctgaaggagggcaaccgctacgacgtggcgtgcgtgtacgccgggtaccggcactccgagagctccctcacccgcgaggagatcgccaacaaggtcctgaaggaccgcctgatgctcctgcccaagaacagcctgcacaaccccgtggtggagaagatcctcaaccagatggtcaacgtgatcaacgtgatcatcgacatctacggcaagccggacgagatccgggtcgagctggcccgcgagctgaagaagaacgccaaggagcgggaggagctcacgaagtccatcgcgcagaccaccaaggcccacgaggagtacaagaccctgctgcagacggagttcgggctcaccaacgtgagccgcaccgacatcctgcggtacaagctgtacaaggagctcgagtcctgcggctacaagaccctgtacagcaacacctacatctcccgcgagaagctgttcagcaaggagttcgacatcgagcacatcatcccccaggcccggctgttcgacgacagcttctccaacaagacgctggaggcccgcagcgtgaacatcgagaagggcaacaagaccgcgtacgacttcgtcaaggagaagttcggggagtccggcgccgacaacagcctggagcactacctcaacaacatcgaggacctgttcaagtccgggaagatcagcaagaccaagtacaacaagctgaagatggccgagcaggacatccccgacggcttcatcgagcgggacctccgcaacacccagtacatcgccaagaaggccctgtccatgctgaacgagatcagccaccgggtggtggcgacgtccggcagcgtcaccgacaagctccgcgaggactggcagctgatcgacgtgatgaaggagctgaactgggagaagtacaaggccctcgggctggtggagtacttcgaggaccgggacggccgccagatcgggcggatcaaggactggaccaagcgcaacgaccaccggcaccacgccatggacgccctgaccgtcgccttcacgaaggacgtgttcatccagtacttcaacaacaagaacgcgtccctcgaccccaacgccaacgagcacgccatcaagaacaagtacttccagaacggccgcgccatcgccccgatgcccctgcgggagttccgcgcggaggccaagaagcacctggagaacaccctcatcagcatcaaggccaagaacaaggtgatcaccgggaacatcaacaagacccggaagaagggcggcgtcaacaagaacatgcagcagacgccccgcgggcagctgcacctggagaccatctacggctccgggaagcagtacctcaccaaggaggagaaggtgaacgccagcttcgacatgcgcaagatcggcaccgtgtccaagctggcgtaccgggacgccctgctcaagcgcctgtacgagaacgacaacgaccccaagaaggccttcgccgggaagaacagcctggacaagcagccgatctggctcgacaaggagcagatgcggaaggtccccgagaaggtgaagatcgtgacgctggaggccatctacaccatccgcaaggagatctcccccgacctgaaggtcgacaaggtgatcgacgtgggcgtccggaagatcctcatcgaccgcctgaacgagtacggcaacgacgcgaagaaggccttcagcaacctggacgagaaccccatctggctcaacaaggagaaggggatcagcatcaagcgggtgaccatctccggcatcagcaacgcccagtccctgcacgtgaagaaggacaaggacgggaagccgatcctggacgagaacggccgcaacatccccgtcgacttcgtgaacaccgggaacaaccaccacgtggccgtctactaccggcccgtgatcgacaagcgcggccagctcgtggtcgacgaggccggcaaccccaagtacgagctggaggaggtggtggtcagcttcttcgaggcggtgacgcgggccaacctggggcagccgatcatcgacaaggactacaagaccaccgagggctggcagttcctcttctccatgaagcagaacgagtacttcgtgttccccaacgagaagaccgggttcaaccccaaggagatcgacctgctggacgtcgagaactacggcctcatcagcccgaacctgttccgcgtgcagaagttctccctgaagaactacgtgttccggcaccacctcgagacgaccatcaaggacaccagctccatcctgcgcgggatcacctggatcgacttccggagctccaagggcctggacacgatcgtcaaggtgcgcgtcaaccacatcggccagatcgtgagcgtgggggagtactga

SEQ ID NO: 2203 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagaactacaccgagtggaacaaggagaagggcaagacggagcagcaggagcgggagcacaagctcgaggggatctactccaagcgcaagcgcgacgaggccaagcgggagaacctgcagtggcgcgtgaacggcctgaaggagaagctcagcctggagcagctggtcatcgtgttccaggagatgaacacccagatcaacaactccagcgggtacctcggcgccatctccgaccggagcaaggagctgtacttcaacaagcagaccgtgggccagtaccagatggagatgctggacaagaaccccaacgcctccctccgcaacatggtcttctaccggcaggactacctggacgagttcaacatgctgtgggagaagcaggccgtgtaccacaaggagctcaccgaggagctgaagaaggagatccgcgacatcatcatcttctaccagcggcgcctcaagagccagaaggggctgatcggcttctgcgagttcgagtcccggcagatcgaggtggacatcgacgggaagaagaagatcaagacggtcggcaaccgcgtgatcagccggtccagcccgctgttccaggagttcaagatctggcagatcctgaacaacatcgaggtgaccgtcgtggggaagaagcgcaagcggcgcaagctcaaggagaactacagcgcgctgttcgaggagctgaacgacgccgagcagctggagctcaacggctcccggcgcctgtgccaggaggagaaggagctgctcgcccaggagctgttcatccgggacaagatgaccaagagcgaggtgctgaagctcctgttcgacaacccccaggagctggacctcaacttcaagaccatcgacggcaacaagacggggtacgccctgttccaggcctactccaagatgatcgagatgagcggccacgagcccgtcgacttcaagaagcccgtggagaaggtcgtggagtacatcaaggcggtgttcgacctgctcaactggaacaccgacatcctggggttcaactccaacgaggagctggacaaccagccgtactacaagctctggcacctcctgtacagcttcgagggcgacaacacccccaccgggaacggccgcctgatccagaagatgacggagctgtacggcttcgagaaggagtacgccaccatcctggccaacgtctccttccaggacgactacgggagcctctccgccaaggccatccacaagatcctgccccacctgaaggagggcaaccggtacgacgtggcgtgcgtgtacgccgggtaccgccacagcgagtccagcctcacccgcgaggagatcgccaacaaggtcctgaaggaccggctgatgctcctgcccaagaactccctgcacaacccggtggtggagaagatcctcaaccagatggtcaacgtgatcaacgtgatcatcgacatctacggcaagcccgacgagatccgcgtcgagctggcccgggagctgaagaagaacgccaaggagcgcgaggagctcaccaagagcatcgcgcagacgaccaaggcccacgaggagtacaagaccctgctgcagaccgagttcgggctcacgaacgtgtcccggaccgacatcctgcgctacaagctgtacaaggagctcgagagctgcggctacaagaccctgtactccaacacctacatcagccgggagaagctgttctccaaggagttcgacatcgagcacatcatcccccaggcccgcctcttcgacgacagcttcagcaacaagaccctggaggcccggtccgtgaacatcgagaagggcaacaagacggcgtacgacttcgtcaaggagaagttcggggagagcggcgccgacaactccctggagcactacctcaacaacatcgaggacctgttcaagagcgggaagatctccaagaccaagtacaacaagctgaagatggccgagcaggacatccccgacggcttcatcgagcgcgacctccggaacacccagtacatcgccaagaaggccctgagcatgctgaacgagatctcccaccgcgtggtggcgaccagcggctccgtcacggacaagctccgggaggactggcagctgatcgacgtgatgaaggagctgaactgggagaagtacaaggccctcgggctggtggagtacttcgaggaccgcgacggccggcagatcgggcgcatcaaggactggaccaagcggaacgaccaccgccaccacgccatggacgccctgaccgtcgccttcaccaaggacgtgttcatccagtacttcaacaacaagaacgcgagcctcgacccgaacgccaacgagcacgccatcaagaacaagtacttccagaacggccgggccatcgcccccatgcccctgcgcgagttccgggcggaggccaagaagcacctggagaacacgctcatctccatcaaggccaagaacaaggtgatcaccgggaacatcaacaagacccgcaagaagggcggcgtcaacaagaacatgcagcagacgccccgcgggcagctgcacctggagaccatctacggcagcgggaagcagtacctcaccaaggaggagaaggtgaacgcctccttcgacatgcggaagatcggcaccgtgagcaagtccgcgtaccgcgacgccctgctgaagcggctctacgagaacgacaacgacccgaagaaggccttcgccgggaagaacagcctggacaagcagcccatctggctggacaaggagcagatgcgcaaggtccccgagaaggtgaagatcgtgaccctcgaggccatctacacgatccggaaggagatctccagcgacctgaaggtcgacaaggtgatcgacgtgggcgtccgcaagatcctgatcgaccggctcaacgagtacggcaacgacgcgaagaaggccttcagcaacctggacaagaaccccatctggctgaacaaggagaaggggatctccatcaagcgcgtgaccatcagcggcatctccaacgcccagagcctccacgtgaagaaggacaaggacgggaagccgatcctggacgagaacggccggaacatccccgtcgacttcgtgaacaccgggaacaaccaccacgtggccgtctactaccgccccgtgatcgacaagcggggccagctggtggtcgacgaggccggcaaccccaagtacgagctcgaggaggtggtggtctccttcttcgaggcggtgacccgcgccaacctggggctgccgatcatcgacaaggactacaagacgaccgagggctggcagttcctcttcagcatgaagcagaacgagtacttcgtgttccccaacgagaagaccgggttcaaccccaaggagatcgacctgctggacgtcgagaactacggcctcatctccccgaacctgttccgggtgcagaagttcagcctgaagaactacgtgttccgccaccacctcgagaccacgatcaaggacacctccagcatcctgcgggggatcacctggatcgacttccgctccagcaagggcctggacaccatcgtcaaggtgcgggtcaaccacatcggccagatcgtgtccgtgggggagtactga

SEQ ID NO: 2204 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagaactacaccgagtggaacaaggagaagggcaagacggagcagcaggagcgggagcacaagctcgaggggatctactccaagcgcaagcgcgacgaggccaagcgggagaacctgcagtggcgcgtgaacggcctgaaggagaagctcagcctggagcagctggtcatcgtgttccaggagatgaacacccagatcaacaactccagcgggtacctcggcgccatctccgaccggagcaaggagctgtacttcaacaagcagaccgtgggccagtgccagatggagatgctggacaagaaccccaacgcctccctccgcaacatggtcttctaccggcaggactacctggacgagttcaacatgctgtgggagaagcaggccgtgtaccacaaggagctcaccgaggagctgaagaaggagatccgcgacatcatcatcttctaccagcggcgcctcaagagccagaaggggctgatcggcttctgcgagttcgagtcccggcagatcgaggtggacatcgacgggaagaagaagatcaagacggtcggcaaccgcgtgatcagccggtccagcccgctgttccaggagttcaagatctggcagatcctgaacaacatcgaggtgaccgtcgtggggaagaagcgcaagcggcgcaagctcaaggagaactacagcgcgctgttcgaggagctgaacgacgccgagcagctggagctcaacggctcccggcgcctgtgccaggaggagaaggagctgctcgcccaggagctgttcatccgggacaagatgaccaagagcgaggtgctgaagctcctgttcgacaacccccaggagctggacctcaacttcaagaccatcgacggcaacaagacggggtacgccctgttccaggcctactccaagatgatcgagatgagcggccacgagcccgtcgacttcaagaagcccgtggagaaggtcgtggagtacatcaaggcggtgttcgacctgctcaactggaacaccgacatcctggggttcaactccaacgaggagctggacaaccagccgtactacaagctctggcacctcctgtacagcttcgagggcgacaacacccccaccgggaacggccgcctgatccagaagatgacggagctgtacggcttcgagaaggagtacgccaccatcctggccaacgtctccttccaggacgactacgggagcctctccgccaaggccatccacaagatcctgccccacctgaaggagggcaaccggtacgacgtggcgtgcgtgtacgccgggtaccgccacagcgagtccagcctcacccgcgaggagatcgccaacaaggtcctgaaggaccggctgatgctcctgcccaagaactccctgcacaacccggtggtggagaagatcctcaaccagatggtcaacgtgatcaacgtgatcatcgacatctacggcaagcccgacgagatccgcgtcgagctggcccgggagctgaagaagaacgccaaggagcgcgaggagctcaccaagagcatcgcgcagacgaccaaggcccacgaggagtacaagaccctgctgcagaccgagttcgggctcacgaacgtgtcccggaccgacatcctgcgctacaagctgtacaaggagctcgagagctgcggctacaagaccctgtactccaacacctacatcagccgggagaagctgttctccaaggagttcgacatcgagcacatcatcccccaggcccgcctcttcgacgacagcttcagcaacaagaccctggaggcccggtccgtgaacatcgagaagggcaacaagacggcgtacgacttcgtcaaggagaagttcggggagagcggcgccgacaactccctggagcactacctcaacaacatcgaggacctgttcaagagcgggaagatctccaagaccaagtacaacaagctgaagatggccgagcaggacatccccgacggcttcatcgagcgcgacctccggaacacccagtacatcgccaagaaggccctgagcatgctgaacgagatctcccaccgcgtggtggcgaccagcggctccgtcacggacaagctccgggaggactggcagctgatcgacgtgatgaaggagctgaactgggagaagtacaaggccctcgggctggtggagtacttcgaggaccgcgacggccggcagatcgggcgcatcaaggactggaccaagcggaacgaccaccgccaccacgccatggacgccctgaccgtcgccttcaccaaggacgtgttcatccagtacttcaacaacaagaacgcgagcctcgacccgaacgccaacgagcacgccatcaagaacaagtacttccagaacggccgggccatcgcccccatgcccctgcgcgagttccgggcggaggccaagaagcacctggagaacacgctcatctccatcaaggccaagaacaaggtgatcaccgggaacatcaacaagacccgcaagaagggcggcgtcaacaagaacatgcagcagacgccccgcgggcagctgcacctggagaccatctacggcagcgggaagcagtacctcaccaaggaggagaaggtgaacgcctccttcgacatgcggaagatcggcaccgtgagcaagtccgcgtaccgcgacgccctgctgaagcggctctacgagaacgacaacgacccgaagaaggccttcgccgggaagaacagcctggacaagcagcccatctggctggacaaggagcagatgcgcaaggtccccgagaaggtgaagatcgtgaccctcgaggccatctacacgatccggaaggagatctcccccgacctgaaggtcgacaaggtgatcgacgtgggcgtccgcaagatcctgatcgaccggctcaacgagtacggcaacgacgcgaagaaggccttcagcaacctggacaagaacccgatctggctgaacaaggagaaggggatcagcatcaagcgcgtgaccatctccggcatcagcaacgcccagtccctccacgtgaagaaggacaaggacgggaagcccatcctggacgagaacggccggaacatccccgtcgacttcgtgaacaccgggaacaaccaccacgtggccgtctactaccgccccgtgatcgacaagcggggccagctggtggtcgacgaggccggcaacccgaagtacgagctcgaggaggtggtggtcagcttcttcgaggcggtgacccgcgccaacctggggctgcccatcatcgacaaggactacaagacgaccgagggctggcagttcctcttctccatgaagcagaacgagtacttcgtgttccccaacgagaagaccgggttcaacccgaaggagatcgacctgctggacgtcgagaactacggcctcatcagccccaacctgttccgggtgcagaagttctccctgaagaactacgtgttccgccaccacctcgagaccacgatcaaggacaccagctccatcctgcgggggatcacctggatcgacttccgcagctccaagggcctggacaccatcgtcaaggtgcgggtcaaccacatcggccagatcgtgagcgtgggggagtactga

SEQ ID NO: 2205 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtgaacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcaccgaggtgctgaaggagcacaagctgatcaccgaggacaccatcctcagcgagaacggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgcgcgcgagctctacaacaacaacctgaccccgggcgagctgtgcctccagctgctggacgccgggaagaagttcctccccgacttctaccggagcgacctgcagaacgagctggaccgcatctgggagaagcagaaggagtactaccccgagatcctcaccgacgtgctgaaggaggagctgcggggcaagaagcgcgacgccgtctgggccatctgcgcgaagtacttcgtgtggaaggagacctacacggagtggaacaaggagaagggcaagaccgagcagcaggagcgggagcacaagctcgaggggatctactccaagcgcaagcgcgacgaggccaagcgggagaacctgcagtggcgcgtgaacggcctgaaggagaagctcagcctggagcagctggtcatcgtgttccaggagatgaacacccagatcaacaactccagcgggtacctcggcgccatctccgaccggagcaaggagctgtacttcaacaagcagaccgtgggccagtaccagatggagatgctggacaagaaccccaacgcctccctccgcaacatggtcttctaccggcaggactacctggacgagttcaacatgctgtgggagaagcaggccgtgtaccacaaggagctcacggaggagctgaagaaggagatccgcgacatcatcatcttctaccagcggcgcctcaagagccagaaggggctcatcggcttctgcgagttcgagtcccggcagatcgaggtggacatcgacgggaagaagaagatcaagaccgtcggcaaccgcgtgatcagccggtccagcccgctgttccaggagttcaagatctggcagatcctgaacaacatcgaggtgaccgtcgtggggaagaagcgcaagcggcgcaagctcaaggagaactacagcgcgatcttcgaggagctgaacgacgccgagcagctggagctgaacggctcccggcgcctctgccaggaggagaaggagctgctggcccaggagctgttcgtgcgggacaagatgaccaagagcgaggtcctgaagctcctgttcgacaacccccaggagctggacctgaacttcaagacgatcgacggcaacaagaccgggtacgccctcttccaggcctactccaagatgatcgagatgagcggccacgagcccgtggacttcaagaagcccgtcgagaaggtggtggagtacatcaaggcggtcttcgacctgctgaactggaacaccgacatcctcgggttcaactccaacgaggagctggacaaccagagctactacaagctgtggcacctcctgtactccttcgagggcgacaacaccccgacggggaacggccgcctgatccagaagatgaccgagctctacggcttcgagaaggagtacgccaccatcctggccaacgtgagcttccaggacgactacgggtccctgagcgccaaggccatccacaagatcctcccccacctgaaggagggcaaccggtacgacgtggcgtgcgtctacgccgggtaccgccactccgagagctccctgacccgcgaggagatcgccaacaaggtgctcaaggaccggctgatgctgctccccaagaacagcctgcacaaccccgtggtcgagaagatcctgaaccagatggtgaacgtgatcaacgtcatcatcgacatctacggcaagccggacgagatccgcgtggagctcgcccgggagctgaagaagaacgccaaggagcgcgaggagctgacgaagtccatcgcgcagaccaccaaggccaacgaggagtacaagaccctcctgcagacggagttcgggctgaccaacgtgagccggaccgacatcctccgctacaagctgtacaaggagctggagtcctgcggctacaagaccctctacagcaacacctacatctcccgggagaagctgttcagcaaggagttcgacatcgagcacatcatcccccaggcccgcctgttcgacgacagcttctccaacaagacgctcgaggcccggagcgtcaacatcgagaagggcaacaagaccgcgtacgacttcgtgaaggagaagttcggggagtccggcgccgacaacagcctggagcactacctgaacaacatcgaggacctcttcaagtccgggaagatcagcaagaccaagtacaacaagctgaagatggccgagcaggacatccccgacggcttcatcgagcgcgacctgcggaacacccagtacatcgccaagaaggccctctccatgctgaacgagatcagccaccgcgtggtcgcgacgtccggcagcgtgaccgacaagctgcgggaggactggcagctcatcgacgtgatgaaggagctgaactgggagaagtacaaggccctggggctcgtcgagtacttcgaggaccgcgacggccggcagatcgggcgcatcaaggactggaccaagcggaacgaccaccgccaccacgccatggacgccctgaccgtggccttcacgaaggacgtgttcatccagtacttcaacaacaagaacgcgtccctggaccccaacgccaacgagcacgccatcaagaacaagtacttccagaacggccgggccatcgccccgatgcccctccgcgagttccgggcggaggccaagaagcacctggagaacaccctgatcagcatcaaggccaagaacaaggtcatcaccgggaacatcaacaagacccgcaagaagggcggcgtgaacaagaacatgcagcagacgccccgcgggcagctccacctggagaccatctacggctccgggaagcagtacctgaccaaggaggagaaggtgaacgccagcttcgacatgcggaagatcgagaccgtctccaagagcgcgtaccgcgacgccctcctgaagcggctgtacgagaacgacaacgaccccaagaaggccttcgccggcaagaactccctcgacaagcagccgatctggctggacaaggagcagatgcgcaaggtgcccgagaaggtgaagatcgtcacgctggaggccatctacaccatccggaaggagatcagccccgacctcaaggtggacaaggtgatcgacgtcggggtgcgcaagatcctgatcgaccggctgaacgagtacggcaacgacgcgaagaaggccttcagcaacctcgacaagaaccccatctggctgaacaaggagaagggcatctccatcaagcgcgtgaccatcagcgggatctccaacgcccagagcctgcacgtcaagaaggacaaggacggcaagccgatcctcgacgagaacgggcggaacatccccgtggacttcgtgaacaccggcaacaaccaccacgtcgccgtgtactaccgccccgtgatcgacaagcgggggcagctggtcgtggacgaggccggcaaccccaagtacgagctggaggaggtggtcgtgtccttcttcgaggcggtgacgcgcgccaacctcggcctgccgatcatcgacaaggactacaagaccaccgaggggtggcagttcctgttcagcatgaagcagaacgagtacttcgtcttccccaacgagaagatcggcttcaaccccaaggagatcgacctcctggacgtggagaactacgggctgatctccccgaacctcttccgggtgcagaagttcagcctgaagaactacgtcttccgccaccacctggagaccacgatcaaggacacctccagcatcctccggggcatcacctggatcgacttccgctccagcaaggggctggacaccatcgtgaaggtccgggtgaaccacatcggccagatcgtgtccgtcggcgagtactga

SEQ ID NO: 2206 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtggacgaggccgagaacaaggacgagcggtccagcatcgtcaagctcggggtgcgcgtgaaccccctgaccgtcgacgagctgacgaacttcgagaagggcaagtccatcaccaccaacgcggaccggaccctcaagcgcgggatgcggcgcaacctgcagcggtacaagctgcgccgggagacgctcatggaggtgctgaaggagcacaagctgatcaccgaggacaccatcctcagcgagaacggcaaccgcaccacgttcgagacctaccggctgcgcgccaaggccgccaccgagaagatctccctggaggagttcgcccgggtgctcctgatgatcaacaagaagcgcggctacaagagctgccggaaggcgaagggggccgaggagggcaccctgatcgacgggatggacatcgcccgcgagctctacaacaacaacctgacgccgggcgagctgtgcctccagctgctggacgccgggaagaagtacctccccgacttctaccggtccgacctgcagaacgagctggaccgcatctgggagaagcagaaggagtactaccccgagatcctcaccgaggtcctgaaggaggagctgcggggcaagaagcgcgacgcggtgtgggccatctgcgccaagagcttcgtgtgggaggagtactacaccgagtggaacaaggagaagggcaagaccgagcagcaggagcgggagcacaagctcgaggggatctactccaagcgcaagcgcgacgaggccaagcgggagaacctgcagtggcgcgtcaacggcctgaaggagaagctcagcctggagcagctggtgatcgtgctccaggagatgaacatccagatcaacaactccagcgggtacctgggcgccatctccgaccggagcaaggagctgtacttcaacaagcagacggtcggccagtaccagatggagatgctcgacaagaaccccaacgcgtccctgcgcaacatggtgttctaccggcaggactacctggacgagttcaacaccctctgggagaagcaggccgagtaccacaaggagctgaccggggagctgaagaaggagatccgcgacatcgtgatcttctaccagcggcgcctcaagagccagaagggcctggtcgggttctgcgagttcgagtcccggcagatcgaggtggagatcgacggcaagaagaagatcaagaccgtggggaaccgcgtcatcccgcggagcagccccctgttccaggagttcaagatctggcagatcctcaacaacatcgaggtgacggtggtcggcaagaagggcaagcgccggaagcagaaggacaactcccccaccctgttcgacgggctggacgacaccgagcagctggagctcaacggcagccgctacctgtaccaggaggagaaggagctgctcgcccaggagctgttcgtgcgggacaagatgaccaagtccgacgtgctgaagctcctgttcgacaacccccaggagctggacctcaacttcaagacgatcgacgggaacaagaccggctacaccctgttccaggcctacagcaagatgatcgagatgtccgggcacgagccggtcgacttcaagaagaccgtggagaaggtcgtggagcacgtgaaggccgtcttcgacctgctcaactggaacacggacatcctgggcttcaacagcaacgaggagctggacaaccagtcctactacaagctctggcacctcctgtacagcttcgagggcgacaacacccccaccgggaacgcgcgcctggtgcagaagatcaccgagctgtacggcttcgagaaggagtacgccatcatcctggccaacgtgacgttccaggacgactacgggtccctcagcgccaaggccatccacaagatcctgccccacctgaaggagggcaaccggtacgacgtcgcgtgcgcctacgccgggtacaagcactccgagagctccctcaccaaggaggagatcgccaacaaggccctgaaggaccgcctgaccctcctgcccaagaacaacctgcggaacccggtggtggagaagatcctcaaccagatggtcaacgtgatcaacgcgatcatcgacacctacggcaagcccgacgagatccgcgtggagctggcccgcgagctgaagaagaacgccaaggagcgggaggagctcacgaagttcatcgccgagaccacccgcaagcacgaggagttcaagatcctgctgcagagcgagttcggcctcaccaacgtctcccggaccgacatcctgcgctacaagctgtacaaggagctcgagagctgcgggtacaagacgctgtactccaacacctacatcccccgggagaagctgttcagcaaggagttcgacatcgagcacatcatcccccaggcgcgcctcttcgacgactccttcagcaacaagaccctggaggcccggtccatcaacctggagaagggcaacaagaccgcctacgacttcgtgaaggagaagttcggggagagcggcgccgacaacagcctcgaccactacctgaacaacatcgaggacctgttcaagtccggcaagatcagcaagacgaagtacaacaagctcaagatggccgagcaggacatcccggacgggttcatcaaccgcgacctgcggaacacccagtacatcgcgaagaaggccctgtccatgctcaacgagatcagccgccgggtggtcgccacctccggcaccatcacggacaagctgcgccaggactggcagctggtggacgtgatgaaggagctcaactgggagaagtacaaggccctggggctggtcgagtacttcgaggacaaggacggccggcagatcgggcgcatcaaggactggaccaagcggaacgaccaccgccaccacgccatggacgcgctcaccgtggccttcaccaaggacatcttcatccagtacttcaacaacaagaacgccagcctgaactccaacacgaacgagtacgccatcaagaacaagtacttccagaacggccgggccatcgcgcccatccccctgcgcgagttccgggtggaggccaagaagcacctcgagaacaccctgatcagcatcaaggccaagaacaaggtcgtgaccggcaacatcaacaagaccaagaagcgcgggggcgtgaacaagtacctgcagcagacgccccgggggcagctccacctggagaccatctacggctccgggaagcagtacctgaccaaggaggagaaggtcaacgccagcttcgacatgaagaagatcgcgaccgtgtccaagagcgcctaccgcgacgtgctcctgaagcgcctgcacgagaacgacaacgacccgaagaaggccttcacgggcaagaactccctcgacaagcagcccatctggctggacaaggagcagacccggaaggtccccgagaaggtgaagaccgtgaccctggagacgatctacaccgtccgcaaggagatcagccccgacctcaaggtggacaaggtgatcgacgccggcgtccggaagatcctgaccgggcgcctgaacgagtacggcaacgacgccaagaaggcgttctccaacctcgacgagaacccgatctggctgaacaaggagaaggggatcagcatcaagcgggtgaccatctccggcatcagcaacgcccagagcctgcacgtgaagaaggacaaggacgggaagcccatcctcgacgaggactcccgcaacatccccgtcgacttcgtgaacacgggcaacaaccaccacgtggccgtctaccggcgccccgtgatcgacaagcggggccagctggtgatcgacgaggccgggaacccgaagtacgagctggaggaggtcgtggtgagcttcttcgaggccgtcacccgcgcgaacctcggccagcccatcatcgacaaggactacaagacctccgaggggtggcagttcctgttcagcatgaagcagaacgagtacttcgtgttccccaacgagaagaccggcttcaacccgaaggagatcgacctgctcgacgccgagaactacggggtgatctcccccaacctgttccgggtccagaagttcgcccacaagaactacgtgttccgccaccacctggagacgaccatcaaggacaccagctccatcctcaagggcatcacctggatcgacttccggagctccaagggcctggacgccatcgtgaaggtccgcgtgaaccacatcgggcagatcgtcagcgtgggcgagtactga

SEQ ID NO: 2207 - RNA, 4311 nt, synthetic construct
  misc_feature 1..4311: note = Cas9 variant
  source 1..4311: mol_type = other RNA
atgaagtacatcaagtacatcctgggcctcgacatcgggagcaactccatcggctgggccctgatccagctggacctcctgcagaagaccaagcgcatcatcgccgcggggagccggatcatccccatggaccagaaggtgctgtccgacttcggcaaggggatcaccatcagcccgacggcccagcgcacctcctaccggaacgcccgccactgccgggagcgccacctcctgcggcgcgagcggctgcaccgcgtcctccacatcctgggcttcctgcccacccactacgacaagcagatcgacttcagcaagcggtacggcaagttcgtggacaacaccgagcccaagatcgcctacaacgaggggaagttcctcttcatggactccttccaggagatgctgagcgacttcaagtcccaccagcccgacctgttctacacgaagaagaacggcgaggagagcaagatcccgtacgactggaccatctactacctccgcaagaaggccctgtcccagaagatcagcaaggaggagctggcgtggatcatcctcaacttcaaccagaagcgggggtactaccagctgcgcgaggaggagggcaacaaggagaacgacttcgagatcatctccagcaagatcatctccgtgatcaagaaggacaaggacaagaagtacaacaagtactggtacgacatcatcctggagaacgggctcgtctaccaggccgccttctacaacgacttcgtgtacaactggatcaaccaggaccgggagttcatcatcgagcgcaccagcctgaagaacggcgccgagaaggtgaagctgtcctacctccccaccttcgacgagatcgacaagatggacaagaaggagcaggacaagtactacaagaagatcaagatcaagacggagaacagcatcggcaacaagaccgtcgggtgctacatctacgaccacatcctgcagaaccccaacgagaagatcaagggcaagctggtgcggaccatcgagcgcaagtactacaaggaggagctcaaggcgatcctggagaagcagatcgccctgcagcccgagctgttcaccgaccagctgctggccgactgcatccgggagctctactccaagaacgaggcccagcagcgcaacctggccgcgcgggacttcgtgcacctcctcgtcgaggacatcatcttctaccagcgcccgctgcgccggcagaagtccacgctggccaactgcagcctcgagagccgcagctacatcgacaaggactcccacacccggaaggaggcgcccctgaaggtgtgccccaagagcaacccctactaccaggagttccgcgtgctgcagtggctccagaacctgaagatctacgagatcgactccgaccaggaggtcacccaccagttcatcaagaccctggaggacaagcagcagctgttcgagttcctgatggcccagaaggagatcgactgcgaggagctgctcaagtacttcctgaaccagacgtacccgaacgccaaggagaaggccctcaagagcgagctgaagaagtggaaggacacctaccggtggaactacgtgtacgacatcggggagaagtccagcaagaagtaccccatgaacgagacccgctacgagctcaagcggcacctggagaaggtggccaacctgcccgacgacttcctctccagcgaggtcgagtacctgctgtggcacctcatctactccgtgaaggacaaggtggcctacgagaagggcctgaagaagttcgcccagaagcaccacctggacaaggacagcttcgtcgagtccttcaagaagttcaacccctacccgagcgagtacggctccttcagcgagaaggccatccgcaagctcctgcccctgatgcggttcggggcgcactgggacttcaaccacatcgacaagaacacccagaagcgcatcgaggacctcatcacgggcgtggagaacgaggagatccggaccatcctgcgcgagaaggccgagaagtaccagctggagaaggagaccgacttccaggacctccccctgtggctggcccagtacatcgtgtacaaccggcacgccgaggcctccagcctcgagaagtggacctccgtcaacgacctggagacgtacctgaacgagttcaagcagcacagcctccgcaaccccatcgtggagcaggtcgtgatggagaccctgcgggtggtccgcgacatctggcagcagtacgggcagggccaggcgagcttcttcaacgagatccacatcgagctggggcgggagctcaagaagaccgccaaggagcgcgagaagctgtccaagcagaaccagaagaacgaggacatcaacctgagcatcaaggagaagctcaaggagctggagaagtacaacacccgggcctactccatcacgcaccaggagaagtacaagctgtggctcgagcagaagcacatcagcccgtacaccggccagatcatctcccccgagaacctgttcaccgacaactacgagatcgagcacatcatcccccagagccgcttcttcgacgactccctgagcaacaaggtggtgtgcgagtccatcgtcaacaaggccccctacaaggaccgccagctcggcctggagttcatcaagaaccagggcgggcggatcgtgaaggagctgagcaaggagaacaagaccatcaagatcttcacggaggagcagtaccgcaccttcatcaaggagcactactccaacaacccggagaagaccaagaagctcctgctggaggagatccccgagaagatggtggcgcggcagatgaacgacacgtgctacatcagcaagttcatctccgagatcctcagcaagatcgtccgctccgacgagcaggacgagggggtgcacagcaagaacgtgatcctgtgcaccggcaagatcacctccatcctgcggcaggactgggggctcaacgacatctgggacaacctgatcctgccccgcttcgagcggatgaacaacctcctgcagaaggagaagttcaccatctacagcatcgagaagcagaagaagatccccgtcgtgccgatcaacgaccagttcaagagcttccagaagaagcgcatcgaccaccggcaccacgccatggacgccatcatcatcgcctgcaccacccgcgagcacatcaactacatcaacaaccagcacgccctggagaaggagaaggacaagaaggagaagcaggaggagcgggacaagctccgcgagaagctgtgcatcaagaagtacaacaaccggtccgagggcaactacagctggatcttcaagaagccctgggacacgttcacccaggaggtgcgcgtcgcgctggaggacatcgtggtgtccttcaagcagaacctccgggtcatcaacaaggccaccaactactacgagcgctgggtggaggagaacggcaagtacatcaagaagatggtgaagcaggaggggaccaactgggccatccggaagcccctgcacgaggagacgatcagcggcaagatctacctggaccgcgagaagatcaccaagaacgacatcctcaccgccacccggaagacggtcgactccagcttcgacgacaagcgcatcaagaagatcaccgacaccgggatccagaagatcctgctgaactacctcaagtacaagggctccccggagatcgccttcagccccgaggggctggaggagctgaacaagaacctctccatctacaacgacggcaagccccacaagcccatctacaaggtgcggatctacgagaagggcagcgggcgcttcgcgctgggcgagaaggggcgcaagtacaagaagtacgtgcagggcgcctccaacctgtacttcggcatctaccagggggccaagcggagcttcgccaccatcccgctcaacgaggtcatcgagcgccagaagcagggcctgccctccgtgcccgagtacaacgagaagggggacctgctcctgttcagcctgtcccccaacgacctcgtgtacgtcccgatcgagggcgagatcatcgagaacatcgacttccggaacctgagcaaggagcagaaggagcgcatctacaacgtgaacgacttctccagcacgtgctacttcacccccaaccggatcgccaaggcgatcttccccaaggaggtggacctgcagcgcaagggggacaagctctccggcagctacgacaccaagaccgccagcctggagggcatccagatcaaggaggtctgcatcaagctgaaggtggaccggctcgggaacatctccaaggcctga

SEQ ID NO: 2208 - RNA, 4314 nt, synthetic construct
  misc_feature 1..4314: note = Cas9 variant
  source 1..4314: mol_type = other RNA
atgaagtacatcaagtacatcctgggcctcgacatcgggagcaactccatcggctgggccctgatccagctggacctcctgcagaagaccaagcgcatcatcgccaccgggagccggatcatccccatggaccagaaggtgctgtccgacttcggcaaggggatcacgatcagcccgaccgcgcagcgcacctcctaccggaacgcccgccactgccgggagcgccacctcctgcggcgcgagcggctgcaccgcgtcctccacatcctgggcttcctgcccacccactacgacaagcagatcgacttcagcaagcggtacggcaagttcgtggacaacacggagcccaagatcgcctacaacgagcgcaagttcctcttcatggactccttccaggagatgctggccgacttcaagatccaccagcccgacctgttctacaccaagaagaacggggaggagagcaagatcccgtacgactggaccatctactacctccggaagaaggccctgtcccgcaagatcagcaaggaggagctggcgtggatcatcctcaacttcaaccagaagcggggctactaccagctgcgcgaggaggaggaggagaacaaggagaacgacttcgagatcatctccagcaagatcatctccgtgatcaagaaggacaaggacaagaagtacaacaagtactggtacgacatcatcctggagaacgggctcgtctaccaggccgccttctacaacgacttcgtgtacaactggatcaaccaggaccgggagttcatcatcgagcgcatcagcctgaagaacggcaccgagaaggtgaagctgtcctacctccccacgttcgacgagatcgacaagatggacaagaaggagcaggacaagtactacaagaagatcaagatcaagaccgagaacagcatcgggaacaagaccgtcggctgctacatctacgaccacatcctgcagaaccccaacgagaagatcaagggcaagctggtgcggaccatcgagcgcaagtactacaaggaggagctcaaggccatcctggagaagcaggtcgcgctgcagcccgagctgttcacggaccagctgttcgccgactgcatccgggagctgtactccaagaacgaggcccagcagcgcaacctcgccgcccgcgacttcgtgcacctgttcgtggaggacatcatcttctaccagcggagcctgcgccggcagaagtccaccctcgcgaactgcagcctggagagccgctcctacatcgacaaggacagccacacccggaaggaggccccgctgaaggtgtgccccaagtccaacccctactaccaggagttccgcgtcctccagtggctgcagaacctgaagatctacgagatcgacaccgaccaggaggtgacgcacgagttcatcaagaccctcgaggacaagcagcagttcttcgacttcctgatgaaccagaaggagatcgactgcgaggagctgctcaagtacttcctgaaccagacctaccccaacgcccgggagaaggccctcaagagcgagctcaagaagtggaaggacacctaccgctggaactacgtgtacgacatcggggagaagtccagcaagaagtacccgatgaacgagacgcggtacgagctgaagcgccacctggagaaggtcgccaacctgcccgacgacttcctctccagcgaggtggagtacctgctgtggcacctcatctactccgtgaaggacaaggtcgcgtacgagaagggcctgaagaccttcgcccagaagcaccacctggacaaggacagcttcgtggagtccttcaagaagttcaagccctaccccagcgagtacgggtccttcagcgagaaggccatccggaagctcctgccgctgatgcgcttcggctcctactgggacttcaaccacatcgacaagaacacccagaagcggatcgaggacctcatcaccggcgtggagaacgaggagatccgcacgatcctgcgggagaaggccgagaagtaccagctggagaaggagaccgacttccaggacctccccctgtggctggcccagtacatcgtctacaaccgccacgcggaggccagctccctcgagaagtggaccagcgtgaacgacctggagacctacctgaacgagttcaagcagtactccctccggaaccccatcgtggagcaggtcgtgatggagacgctgcgcgtcgtgcgggacatctggcagcagtacgggcagggccaggccagcttcttcgacgagatccacatcgagctggggcgcgagctcaagaagaccgccaaggagcgcgagaagctgagcaagcagaaccagaagaacgaggacatcaacctgtccatcaaggagaagctcaaggagctggagaagtacaacacccgggcctacagcatcacccaccaggagaagtacaagctgtggctcgagcagaagcacatctccccctacacgggccagatcatcagcccggagaacctgttcaccgacaactacgagatcgagcacatcatcccccagtcccgcttcttcgacgacagcctgtccaacaaggtggtctgcgagagcatcgtgaacaaggcgccctacaaggaccggcagctcgggctggagttcatcaagaaccagggcggccgcatcgtgaaggagctgtccaccgagaacaagaccatcaagatcttcacggaggagcagtaccggaccttcatcaaggagcactacagcaacaaccccgagaagaccaagaagctcctgctggaggagatcccggagaagatggtcgcccgccagatgaacgacacgtgctacatctccaagttcatcagcgagatcctctccaagatcgtgcggagcgacgagcaggacgagggggtgcactccaagaacgtcatcctgtgcaccggcaagatcaccagcgccctgaagcaggactggggcgtgaacgacgtgtggaacgacctcatcctgccccgcttcgagcggatgaacgacctgacccagtccaccctcttcaccacgtacaacgagaagtaccagaagtacctgcccaccgtccccatggagtacagcaacgggttccagaagaagcgcatcgaccaccggcaccacgccatggacgcgatcatcatcgcctgcgccacccgcgagcacatcaactacatcaacaaccagcacgccctggagaaggggaaggacaagaaggagaagcagaaggagcacgacaagctccgggagaagctgtgcatcaagaaggacaacaagggcagcgaggagaactactcctggatcttcaagaagccgtgggacaccttcacgcaggaggtgcaggccgcgctggagggcatcgtggtcagcttcaagcagaacctccgcgtgatcaacaaggccaccaactactacgagcggtgggtggaggagaacgggaagtacatcaagaagatggtcaagcaggagggcaccaactgggccatccgcaagcccctgcacgaggagaccatctccgggaagatctacctggaccgggaggagatcacgaagaacgacatcctcaccgccacccgcaagaccgtggacagctccttcgacgagaagcggatcaagaagatcacggacaccggcatccagaagatcctgctgaactacctcaagtacaaggggagccccgagatcgccttctccccggagggcctggaggagctgaacaagaacctcagcatctacaacgacggcaagccccacaagcccatctacaaggtgcgcatctacgagaaggggtccggccggttcgcgctgggggagaagggccgcaagtacaagaagtacgtccagggcgcccccaacctgtacttcgggatctaccagggcgccaacaagcgcagcttcgccaccatcccgctcaacgaggtgatcgagcggcagaagcaggggcgcccctccatccccgagtacaacgagaagggcgaccccctgctgttcagcctctccccgaacgacctggtgtacgtccccgtggagggggagatcatcgaggacatcgacttccagaacctgagcaaggagcagaaggagcggatctacaacgtgaacgacttctccagcacgtgctacttcacccccaaccgcatcgccaaggcgatcttccccaaggaggtcgacctccagcggaagggcgacaagctgccgggctcctacgacaccaagaccgccagcctggaggggatccagatcaaggaggtgtgcatcaagctcaagatcgaccgcctgggcaacatctccaaggcctga

SEQ ID NO: 2209 - RNA, 4317 nt, synthetic construct
  misc_feature 1..4317: note = Cas9 variant
  source 1..4317: mol_type = other RNA
atgaagaccatcctgggcctcgacctggggaccaacagcatcggctgggccctgatcaagcagaacttcgagaacaagtacggggagatcctcggcatggggtcccgcatcatccccatgagccaggacatcctgggcgagttcggcaaggggaactccgtgagccagacggccgcgcggaccgactaccgcgccacccggcgcctgcgggagcgcttcctcctgcggcgcgagcggctgcaccgcgtcctcaacgtgctgaacttcctgccggagcactacgcctcccagatcgacttcgacaagcggttcggcaagttcaaggtggagaccgagcccaagctcgcctggaagaacatcgacgggaagttcagcttcctgttccagacgtccttcaacgagatgctggaggacttcaaggcccacggccaggacctcaaggtcccctacgactggaccatctactacctgcgcaagaaggcgctgagccagaagatcgagaaggaggagctcgtgtggatcctgctgaacttcaaccagaagcgggggtactaccagctccgcggcgaggaggaggaggagaaccccaacaagctgatcgagttctactccctgaagatcatcgacgtgctcgccgacgagccgcagaagggcaagagcgacatctggtactccctggtcctggagaacgggtggatctaccggcgcagctccaagaccagcctcctggactggaaggacaagatccgggacttcatcgtgaccacggacctgaacgacgacggctccgtgaagaccgacaaggaggggaacgagaagcgcagcttccgggcccccggcgagaacgactggaccctcgtcaagaccaagacggagcaggagatcgaccgctcccggaagaccgtgggcaactacatctacgagaccctgctgcagaaccccaagcagaagatcaaggggaagctcgtgcgcaccatcgagcgcaagttctacaaggaggagctgaagcggatcctggagaagcagaaggagttccaccgcgagctcgagagcaacgacctgtacaacgactgcatccgggagctgtaccgcaacaacgaggcccaccagctcacgctgtccaagaaggacttcgtccacctgttcatggaggacatcatcttctaccagcggcccctcaagagccagaagtccagcatcagcaactgcaccctggagttccgcaagtacaaggacgagaacggcatcgagcacacccagttcctgaaggcgatcccgaagtccaacccctactaccaggagttccggatctggcagtggatcttcaacctcaacatctacaagaaggacaacgacgacaacgtgaccaaggagttcctgaacacgacccgcgacttcgagaacctgttcgagttcctcaacaaccggaaggagatcgagcagaagcccctgctgaagttcctgctcgagcagaaggagttcaaggggaagctgctgaacgccgagaccgagaagttccgctggaactacgtggaggacaagaagtacccctgcaacgagacccggacgatgatcagcgagcgcctcaagaaggtcgagaacatctccgacgacttcctgacccgggagatggagcagaagatctggcacatcatctacagcgtgaacgacaagaccgagtacgagaaggccctgaagtccttcgccgagaagaacaacctcgacgagaacagcctgttcgaggccttcaagaagctgccgcccttcaagtccgagtacggcagcttctccgagaaggcgatcaagaagctcctgcccctgatgcgcctcgggaagtactggagctacgccaagatcgacctgtactccaagaaccggatccagaagatcatcaccggcgagttcgacgagaacatcaaggaccgcgtgcgggagaaggccatccgcctgacggccgagaacgacttccagggcctccagctgtggctggcccagtacatcgtctacgggcggcacagcgaggcgtccatgatcggcaagtggaacagcgccgacgacctcgaggagttcctgaaggagttcaagcagcactccctgcgcaaccccatcgtggagcaggtcatcaccgagaccctccgcatcgtgaaggacatctggctgaagtacgggaacggcgccaaggacttcttcaacgagatccacatcgagctggggcgggagatgaagcagaccaaggacgagcgcgccaacgccacgaagaccatcaccgagaacgagaacaccaacctccggatcaaggcgctgctggccgagatgatgaacgaccacagcgtggagaacgtgcgcccgtactcccccatgcagcaggagatcctcaagatctacgaggacggcatcctcaagagcgacatcgagatcgacgacgacatcctgaagatcagcaagacggcccagccctccagctccgacctgaagcggtacaagctgtggctggagcagaagtacaagagcccctacaccggccagatcatcccgctcaacaagctgttcacccccgagtacgagatcgagcacatcatcccccagtcccgctacttcgacgacagcttctccaacaagatcatctgcgagagcgccgtcaacaagctgaaggacaactacatcgggctcggcttcatcaagcagttcgggggcaccatcatcgagtgcgggttcggcaagcgggtgaaggtcttcgaggtgggcgagtacgaggagttcgtgaagaagcactacgccaacaaccgcgggaagcggaacaagctgctgctcgaggagatccccgagaagatgatcgagcgccagatgaacgacacccggcacatctccaagtacatcagcggcatcctgtcccacatcgtccgcgtggaggacgggacggacgagggcgtgaacagcaagaacgtcatcccgggcaacgggaagatcaccacccagctgcggcaggactggggcctcaacgacgtgtggaacgagctgatcctgccccgcttcgagcggatgaaccagctcaccaactccacggacttcaccagctggaacgagaaccaccagaagtacctgcccaccgtgcccgtcgagttctccaaggggttcagcaagaagcgcatcgaccaccggcaccacgcgctggacgccctcgtgatcgcctgcgccaccaaggaccacgtgaacctgctgaacaaccagtccgccaagagcgcgacgaagcgctacgacctcaagaagaagctgatgaagttcgagaagaccgtctacaaggacccgcagaccgagaagcggatcgagcgcgaggtgcccaagcacttcctgaagccctgggagaccttcacggtggacgccaagaaccggctcgagaccatcatcgtcagcttcaagcagaacctgcgcgtgatcaacaaggccaccaactactacgagaagtacgtggagaaggacggcgtcatgatgaaggagcgcgtggagcagaccgggacgaactgggccatccggaagccgatgcacaaggagaccgtgtccggcaagatcgacctgccctgggtcaaggtgcccaagggcaagatcctcaccgcgacccgcaagagcctggacacgtccttcgacctgaaggccatcgccagcatcaccgacaccgggatccagaagatcctcaagaactacctggagttcaaggagtcccccgagctggccttcagcccggagggcatcgaggacatgaacaagaacatcgagaagtacaacgggggccggccccaccagcccatctccaaggtgcgcgtcttcgagctcgggagcaagttccaggtgggccagaccggcaacaagaaggacaagtacgtggaggccgcgaaggggacgaacctgttcttcgccatctacgaggacaagaagggcaagcggtcctacgagaccatccccctgaacgaggtcatcgagcgccagaagcaggggctcagcgtggtggacctgaagaacgtcaacgacttcttcctgtgcccgaacgacctcgtgtacatcccctccggcgacgagttcgagaaccgggggagcatcgagatcgagaacatcaccaaggagaagtccgagcgcttctacaaggtggtcagcttctccggcagccagatcttcttcgtgcggcacgacatcgccgtgtccatcgtcaacaagggcgagttcagcaccctgaacaagatggagcgcgccatcgacgggtccatggtgaaggagatctgcatcaagctgaagatcgaccggctcggcgacgtgctgaaggcctga

SEQ ID NO: 2210 - RNA, 4317 nt, synthetic construct
  misc_feature 1..4317: note = Cas9 variant
  source 1..4317: mol_type = other RNA
atggtgaagaagggctacaccatcgggctggacatcggcaccacgagcgtcgggtgggccgtgaccgacgacgacttcgagctcgtgaacaagaagatgtccatcaaggacaagagcggctccaccatcaagcgcgtccggaagaacctgtggggcgtgcgcctgttcgacgaggccaagaccgcggagaacacgcggcgcacccgcggggtgcggcggcgcatccggcgccggaaggagcgcctcaactacctgcagggcatcttcagctccgagatggccaagatggacgagaacttcttcatgcggctggaggagagcttcttcaagctctccgacaagagcgagcagaacaagttcccctacgccctgttcaagaacgagatcgaggagaaggcctactaccgccagttcccgaccatctaccacctccggaagcacctcatggagcacgaggagtccgacctgcgcaagatctacctggggctccaccacatcctgaagtaccggggccacttcgtccaggaggggcagaagatggacgtggccaacatcgacatccagggcaacctgaaggagctgttcaacgcgctgaacgagaacttcagcaacaaggaggacgacttcgagcaggagcgcatgaaggacggggtgaagcgggccaaggtcctgttcgacaccgagaagctcgccgccgtggaggagatcctgaaggagaagatctccaagagctggaaggtgaacaagatctccaagggcatcctggcggagaagaaggacctccccatcttcaaggccatcgtcggcaacaagatcgacctggccgggatcttcgactgccccgactacgccgagaaggtgaacgagagcatcaaggagctgaaggacaaggtgtacttcaacaaggaggacttcgaggagacgttcgagaagctctcccagctgctgaaggaggaggagctcgagatcctgatcctggcccgcaagtgctacgaggcggtcctcctggccgacatcatgcagggcgagcagagcctgtccgacgccatggtggccaagtacaacgaccacaagaaggacctcgtgatcttcaagaagttcgtcatcgactacttcagcgaggacgtgtacttcgacctgttcaagaacacccagctggccgggaactaccactcctacgtgaagggcgagcggaagggcaacaagttcaaccacgcgagcctcgacgacttctacaagttcgtcaagaaggagctggacaagaaggccgaggagctgagcgagcaccccgtgtacaagcagatcctccagaagatcgagctggagaccttcctgccgaagcagcgcatgttcaagaacggggccatcccctaccaggtgcacctccacgagctgcgcgccatcatcaagaagcaggagaagcggttccccttcctggccgagaagatcatcatcaaggacaaccagaaggacatctccgagtacaagatcgagaccctcatgaagttccgcatcccctactacgtcggcccgctgatcgaggcgcgggagggggagctgggcaagaagcgcacgaactacagccggttcgcctggatgcagaagtcccccgagagccagaacatcgggatcaccccctggaacttccactccgtggtcgacaaggacgccagcgcctccgagttcatcgagcgcatgaccggcttctgcagctacttccccgaggagccggtgctccccaagaactccctgatctaccagcagttcaccgtgttccaggagctgagcatcgtcggctactacgacgagcagaaccggaagcactacctggacggggagacgcgccggcgcatcttcgaggacctcttcaagaagaaccggaccgtgtccgccggcctgctgcgcaagtggctcgtgtgcaaccagcggaccagccaggaggagaaggagatccgcctgttcgggctggacctcaagaagaacggcctggggtccggcaacttcaacaccaagtacacgacctacctggacctcaaggacgcgggcatcaccgagaagcagctgaagcagcacaaggacttcttcgagaagatcgtcaagtaccagaccatcttcgaggacaagaagatcctgaagcggcgcatcatcctcctgaacgaggagcagcccctgctcagcgaggagcagatcaagaacctggccaagaagcactacacggggtggggcaacctgtccctcaagctgatcgacgggatccaggacaagggcaagaccatcctggactacctcgagacccaggactacaaccagaacctgatgcagctgatgaacgacgagaacaagagcttcgagatgcagatcgagcaggcccgggccgggaaggtgcagttcggcaagatcgactactccttcgtggagcagctcgcgggcagccccgccatcaagcgcgggatctggcagtccctgcagatcgtcgaggagctggtggccttcctcggcaaggagaacatcaagaagatcgtgatcgagatggcccgggagaaccagagcagcaagcgcaccaagtcccgccagaagcagatcgaggccctgtaccagaaggtcacgggggacctgaagaacgagcaggagaagatcgacgtgatgcagaacttcgacaacgagcgggtgttcctctactacctgcagaacggcaagtgcatgcacagcggcgagaagctggagctctcccagctgagcgagtacgagatcgaccacatcatcccgcagacctacatcaaggacgactccttcgacaacaaggtcctggtgacccgcaacgcgaaccagcagaagggcggggacgtgcccagctacgacgtcatcgacaagatgaagtcctactgggagaagctcaaggagaacaacctgatcagcgagaagaagttcgccaacctgaccaaggggaagttcgacgaccagcagctctccggcttcatcaaccggcagctggtggagacgcgccagatcaccaagaacgtggccatcatcctggacaagatctacaacgacgaggccaagaacgagaaggaggtcgccatcatcaccctcaagagcgcgctgacctcccagtaccggcaggggatcatctacgtgcccaacgacgacttcgacgagctgaagctcgtgagcaagacgaactcccgcctgaaggaggtcaagctgcacgacggcttctacaaggtgcgggagatcaacgactaccaccacgcccacgacgcctacctcaacaacgtggtcgccacctacctgtacgaggccatgcccgacctgcgccccctcttcgtgtacggcgagcacagccgggagatccacaagcgcttcctggggaagtacgcgaccacccggaagggccagttcaagcagctgctcgtggacatgcaggacgagtactggatgcgcaaggacaaggaggggaacttcatcgacggcgagatcctgtggcggcgcgacgaggtcctgcagatcgtgaagaaggtgctcgactaccggaacatccagatcaccaagaagctggagatgatggtcaccgggggcgaggagaagtccttctaccaggacagccgctgccggaaggacaagacggccatcccgtacaagaccaactgggacccctccaagtacggcgggttcaagagcccccgcaccgcctacgccatcccggtgatcaagaagaacaagcccaagctggagcccgtgctcctggtcaaccggagcaaggtggagacggacggccagttcgactgcgagaagttcaaggagctgaaccccaccctcaagatcctggggcagccgatctggaagtaccagtccttcgagatgttcgacggcaccaagcgctacatcgcgagcgcctccgagatccacaaggggaaccagatcaagttcagccaggagcacatgaagttcatctcctgctgccagaagtacgacgaggtgaagaacaagctggccttcgacttcgtcaacgagagcaagcacctcttccaggagatcctgaccgccatcaaggacaacatccaccggtaccgcctgatcgccgagggcatcgaggtgcaccgcaagttctccaacatgctcgagaacatcgagaagctgagcacgcaggagctggtggacaacctcctggacgcgatcaacatcacctccgtcggcaccaccaacaacgccttcgggcgggtgcgctacaagggcagctacctgaacgagatctggtccgccacgctcatccaccagagcgtgaccgggctgtacgagacccgggagaagctgatctga

SEQ ID NO: 2211 - RNA, 4323 nt, synthetic construct
  misc_feature 1..4323: note = Cas9 variant
  source 1..4323: mol_type = other RNA
atgaagaccatcctgggcctcgacctggggaccaacagcatcggctgggccctggtggagcaggacttcgagaacaagcaggggctcatcctgggcatggggtcccgcatcatccccatggacgccggcatcatcggcaagttcgcggaggggagctccatcagccagacggccgagcggaccggctaccgctccatccggcgcctgcgggagcgccacctcctgcggcgcgagcggctgcaccgcgtcctcaacatcctgaagttcctgccggagcactacgccgccgagatcgacttcgagaagcggttcgggcagttcctcgccgagaccgagcccaagctggcgtggaagaagtccgccgagggcaagttcgagttcctgttccagcgcagcttcgacgagatggtggccgacttcaaggccaacgggcaggacatcaagatcccctacgactggaccatctactacctccggaagaaggcgctgacgcagaagatcagcccccaggagctggcctggatcatcctcaacttcaaccagaagcgcggctactaccagctgcggggcgaggaggaggaggagaacccgaacaagaaggtggagttctactccctgaagatcgtcgacgtggtggccgacgagcagcccaacaagaagggggacacctggtacagcctccacctggagaacggctgggtctaccgccggtccagcaagatccccctgtacgactggaaggacaaggtgcgcgacttcatcgtgaccaccgacatcaacgaggacgggtccgagaagctcgacaaggacggcgaggtcaagcggagcttccgcgcccccaaggaggacgactggacgctgatcaagaagaagaccgagcaggagatcgagcagttcaaccagaccgtgggctcctacatctacgaggccctgctcgacaacccgacccagaagatccgggggaagctggtgcgcacgatcgagcgcaagttctacaagagcgagctgaagaagatcctcgagaagcagatcgagctgcagcccgagctgttcaccgaggacctctacaacgcgtgcgcccgggagctgtaccgctccaacgtcgcccaccagcagcagctgagctcccgggacttcgtgtacctcttcctgaacgacatcatcttctaccagcgccccctgcggagccagaagtccctcatcagcaactgcagcctggagttccgcaccatcaaggacaaggacggcaacgggcagatcatctacctgaaggccatccccaagtccaacccgtactaccaggagttccgggtgtggcagtggctctacaacctgaagatcttcaccaaggaggacgacaaggacgtcacgaaccagttcatcaacaaggtggaggacctggaggccctcttcgagttcctgatgaaccagaaggaggtgaaccacaccgacatcctgacctacctcatcgagcccatcgtcaagagcaagtaccccaacgcgaagggcaaggccttcaaggacgagctgaagaaggagctgaagaagtaccgctggaactacgtgtacgacgccgacaaggacgagtccaagagctaccccatgaacgagacccggtacgagctgcgcaagcggctcgacaaggtggagaacgtcccggccgacttcatgacgcgcaagatcgagcagcacctgtggcacatcatctactccgtgaccgacaagatcgagttcgagaaggccctcaagagcttcgcgaacaagtacgacctgcaccaggagtccttcgtggagaacttcaagcggttcaagcccttcgacagcgactacgggacctactccgagaaggccatcaagaagctgctgcccctcatgcgcgtcggcaagtactggagctgggagggcatcgacaacaacaccaagaagcggatcgggaagatcatcacgggcgagtacgacgagaccatcaagaaccgcgtgcgggagaaggccatcgacctgaccgaggagaaccacttccaggggctgcagctctggctggcccagtacatcgtctacgaccgccactccgaggccgacatcgcgggcaagtggaacagcgtggccgacctggagcagtacctctccgagttcaagcagcacagcctgcggaaccccatcgtggagcaggtcatcaccgagacgctgcgcgtggtgcgcgacatctggaagcagtacgggaagggcgccaaggactacttcgacgagatccacatcgagctcggccgggagatgaagaacaccgccgaggagcgcaagcggctgtccagcatcatctccgagaacgagaccaccaacctgcgcatccgggcgatcctcgaggagctgatgtacgacgagaacatggagaacgtccgcccgtacagccccatgcagcaggaggccctgaagatctacgaggacggggtgctcagctccagcgtggagatccccgaggacatcgagaagatctccaagaagtccgagcccaccaagagcgagatccagcggtacaagctgtggctggagcagaagtaccgcagcccgtacacgggccggcccatccccctctccaagctgttcacccccgcctaccagatcgagcacatcatcccgcaggcccgcttcttcgacgacgggttcagcaacaaggtcatctgcgagtccgaggtgaacgccctgaaggacaagatgctcggcctggagttcatccagaactactacgggcagaaggtgaccacgagcttcggcgaggtcaccatcctgaccgaggacgcgtacaaggccttcgtgaaggagcactacgacaagaaccggtccaagcgcaacaagctcctgctggaggagatccccgagaagatgatcgaccggcagatgaacgacacccgctacatcagcaagtacatctccaaggtgctcagcaacctggtccggggcgagaaggacgacgagggggtgaactccaagaacatcatccccggcaacgggaagatcagcggcaccctgaagcaggactggggcctcaacgacgtgtggaacgacctgatcctgccgcgcttcgagcggatgaaccagctcacgaactccaccgacttcaccgcctggaacgagaagcaccagaagttcctgcccaccatccccctggagctcagcaaggggttccagaagaagcgcatcgaccaccggcaccacgccctggacgccctgatcatcgcgtgcgccacgcgcgaccacgtcaacctcctgaacaacaagcacgccaagagccggaacgagcgctacgacctgcagcacaagctccgccacaccaccccctggcaggacaaggagggcaaggtgcggaccaagttcacggagttcaagaagccgtgggagaccttcacccaggacaccaagaaggagctggagaagatcgtggtctccttcaagcagaacctgcgcgtgatcaacaaggccacgaactactacgagaagatcgtggacgggaagaaggtcatgttcaagcaggagggcgtgaactgggccatccggaagcccatgcacaaggagaccgtgagcgggaagatcgacctcccccgcgtcaaggtgtccaagggcaagatcctgaccgcgacccgcaagagcctggacacgtccttcaacgccaagaccatcctcagcatcaccgacaccggcatccagaagatcctgctgaactacctcaaggccaaggggaaccccgagctggccttctccccggagggcatcgaggagatgaaccagaacatcagcctgtacaacgacgggaagccccaccagcccatcctcaaggtgcgggtcttcgagcagggctccaagttccccctgggggagacgggcaacaagaccaccaagtacgtggaggcggccaagggcaccaacctgttcttcggggtgtacgagaacaaccagggcaagcggagctacaacacgatcccgctcaacctggtcatcgagcgccagaagcaggggctgaactccgtgcccgagaccaacgagaagggccaccggctcctgttcagcctgtcccccaacgacctcgtgtacgtccccatcgagggggaggtgttcgacaagaccaacccggacgtgaaccgcatctacaagatcgtcagcttctccggcagccagatgttctgcgtgcggcaggacgtggccacctccatcgtctacaagctggagttcagctccctgaacaagatggagcgcacgatcgacggcatcatgatcaaggagatctgcatcaagctcaaggtggaccggctggggaacatcagcaaggcctga

SEQ ID NO: 2212 - RNA, 4323 nt, synthetic construct
  misc_feature 1..4323: note = Cas9 variant
  source 1..4323: mol_type = other RNA
atgaagaccatcctgggcctcgacctggggaccaacagcatcggctgggccctggtggagcaggacttcgagaacaagcaggggctcatcctgggcatggggtcccgcatcatccccatggacgccggcatcatcggcaagttcgcggaggggagctccatcagccagacggccgagcggaccggctaccgctccatccggcgcctgcgggagcgccacctcctgcggcgcgagcggctgcaccgcgtcctcaacatcctgaagttcctgccggagcactacgccgccgagatcgacttcgagaagcggttcgggcagttcctcgccgagaccgagcccaagctggcgtggaagaagaacgccgagggcaagttcgagttcctgttccagcgcagcttcgacgagatggtggccgacttcaaggccaacgggcaggacatcaagatcccctacgactggaccatctactacctccggaagaaggcgctgacgcagaagatcagcccccaggagctggcctggatcatcctcaacttcaaccagaagcgcggctactaccagctgcggggcgaggaggaggaggagaacccgaacaagaaggtggagttctacagcctgaagatcgtcgacgtggtggccgacgagcagcccaacaagaagggggacacctggtactccctccacctggagaacggctgggtctaccgccggagctccaagatccccctgtacgactggaaggacaaggtgcgcgacttcatcgtgaccaccgacatcaacgaggacgggagcgagaagctcgacaaggacggcgaggtcaagcggtccttccgcgcccccaaggaggacgactggacgctgatcaagaagaagaccgagcaggagatcgagcagttcaaccagaccgtgggcagctacatctacgaggccctgctcgacaacccgacccagaagatccgggggaagctggtgcgcacgatcgagcgcaagttctacaagtccgagctgaagaagatcctcgagaagcagatcgagctgcagcccgagctgttcaccgaggacctctacaacgcgtgcgcccgggagctgtaccgccggaacgtcgcccaccagcagcagctgagctcccgcgacttcgtgtacctcttcctgaacgacatcatcttctaccagcggcccctgcgcagccagaagtccctcatcagcaactgcagcctggagttccggaccatcaaggacaaggacggcaacgggcagatcatctacctgaaggccatccccaagtccaacccgtactaccaggagttccgcgtgtggcagtggctctacaacctgaagatcttcaccaaggaggacgacaaggacgtcacgaaccagttcatcaacaaggtggaggacctggaggccctcttcgagttcctgatgaaccagaaggaggtgaaccacaccgacatcctgacctacctcatcgagcccatcgtcaagagcaagtaccccaacgcgaagggcaaggccttcaaggacgagctgaagaaggagctgaagaagtaccggtggaactacgtgtacgacgccgacaaggacgagtccaagagctaccccatgaacgagacccgctacgagctgcggaagcgcctcgacaaggtggagaacgtcccggccgacttcatgacgcggaagatcgagcagcacctgtggcacatcatctactccgtgaccgacaagatcgagttcgagaaggccctcaagagcttcgcgaacaagtacgacctccaccaggagtccttcgtggagaacttcaagcgcttcaagcccttcgacagcgactacgggacctactccgagaaggccatcaagaagctgctgcccctcatgcgggtcggcaagtactggagctgggacatcatcgacgacaagaccaagacgcgcatcggcaagatcatcaccggggagtacgacgagaccatcaagaaccgggtgcgcgagaaggccatcgacctgaccgaggagaaccacttccagggcctgcagctctggctggcccagtacatcgtctacgaccggcactccgaggccgacatcgcggggaagtggaacagcgtggccgacctggagcagtacctctccgagttcaagcagcacagcctgcgcaaccccatcgtggagcaggtcatcacggagaccctgcgcgtggtgcgggacatctggaagcagtacggcaagggggccaaggactacttcgacgagatccacatcgagctcggccgcgagatgaagaacaccgccgaggagcggaagcgcctgtccagcatcatctccgagaacgagaccacgaacctgcggatccgcgcgatcctcgaggagctgatgtacgacgagaacatggagaacgtccggccgtacagccccatgcagcaggaggccctgaagatctacgaggacggcgtgctctccagcagcgtggagatccccgaggacatcgagaagatctccaagaagtccgagcccaccaagtccgagatccagcgctacaagctgtggctggagcagaagtaccggagcccgtacaccgggcgccccatccccctctccaagctgttcacccccgcctaccagatcgagcacatcatcccgcaggcccggttcttcgacgacggcttcagcaacaaggtcatctgcgagtccgaggtgaacgccctgaaggacaagatgctcgggctggagttcatccagaactactacggccagaaggtgacgaccagcttcggggaggtcaccatcctgaccgaggacgcgtacaaggccttcgtgaaggagcactacgacaagaaccgctccaagcggaacaagctcctgctggaggagatccccgagaagatgatcgaccgccagatgaacgacacccggtacatcagcaagtacatctccaaggtgctcagcaacctggtccgcggcgagaaggacgacgagggcgtgaactccaagaacatcatccccgggaacggcaagatcacggggatcctgaagcaggactggggcctcaacgacgtgtggaacgacctgatcctgccgcggttcgagcgcatgaaccagctcaccaacagcaccgacttcaccgcctggaacgagaagcaccagaagttcctgccctccgtccccctggagctcagcaagggcttccagaagaagcggatcgaccaccgccaccacgccctggacgccctgatcatcgcgtgcgccacgcgggaccacgtgaacctcctgaacaacaagcacgccaagtcccgcaacgagcgctacgacctgcagcacaagctccggcacaccaccccctggcaggacaaggaggggaaggtgcgcaccaagttcacggagttcaagaagccgtgggagaccttcacccaggacaccaagaaggagctggagaagatcgtcgtgaacttcaagcagaacctgcgggtgatcaacaaggccacgaactactacgagaagatcgtcgacggcaagaaggtgatgttcaagcaggagggggtgaactgggccatccgcaagcccatgcacaaggagaccgtcagcggcaagatcgacctcccccgggtgaaggtgagcaaggggaagatcctgaccgcgacccgcaagtccctggacacgagcttcaacgccaagaccatcctctccatcaccgacaccggcatccagaagatcctgctgaactacctcaaggccaagggcaaccccgagctggccttcagcccggaggggatcgaggagatgaaccagaacatctccctgtacaacgacggcaagccccaccagcccatcctcaaggtccgggtgttcgagcaggggagcaagttccccctgggcgagacggggaacaagaccaccaagtacgtggaggcggccaagggcaccaacctgttcttcggcgtctacgaggacaaccaggggaagcgctcctacgacacgatcccgctcaacatcgtgatcgagcggcagaagcagggcctgaacagcgtgcccgagaccaacgagaaggggcaccgcctgctgttctccctgagccccaacgacctggtctacgtgcccatcgagggcgaggtgttcgacgagaccaacccggacgtcaaccggatctacaaggtggtgtccttcagcgggtcccagatgttctgcgtccgccaggacgtggccaccagcatcgtgtacaagctcgagttctccagcctgaacaagatggagcggacgatcgacggcatcatgatcaaggagatctgcatcaagctgaaggtcgaccgcctcggcaacatctccaaggcctga

SEQ ID NO: 2213 - RNA, 4332 nt, synthetic construct
  misc_feature 1..4332: note = Cas9 variant
  source 1..4332: mol_type = other RNA
atgatcaagctgctctacctggagaagctgaagcagtacaccatgaagaagatcctcggcctggacctggggaccagctccatcggctgggccctcgtgaacgaggccgagaacagcgacgaggtctccagcatcatcaagctgggggtgcgcgtgaaccccctgacggtcgacgagatgcagaacttcgagaagggcaagtccatcaccaccaacgcggaccggaccctcaagcgcagcatgcggcgcaacctgcagcggtacaagctgcgccgggacgccctcatcgagctgctgaagaaggtggggttcatcacggacaagaccatcctctccgagcagggcaaccgcaccaccttcgagacgtaccggctgcgcgccaaggccgccgaggaggagatcagcctgaaggagctcgcgcgggtgctgctgatgatcaacaagaagcgcggctacaagtccagccggaaggccaagggggaggaggagggcgccctcatcgacgggatggagatcgccaagaagctgtacgacgaggacctgaccccgggccagctctgcctgcagctgctcgagtccgggaagaagttcttccccgacttctaccgcagcgacctgcaggaggagttcaacaagatctgggacttccagaagcagttcaacctgttctccttctgcgacgtcgcgaaggaggaggtgaagggcaagaacaagagccagacctgggccatcctcgccaagtacttcgtggagaccaagaaggtcaacgtgtggaacgagcacgaggcccagacggagaaccgggaggaggtgtacaagctggtcggcctgaagcgcaccgtgaagggggaggagctcaagaaggagaactaccggtggcgcgtgcaggccctgaccgagcagctggacctcgagaagatcgcggtcgtgctgcaggagatcaacggccagatctccgccagctccgggtacctgggcgccatcagcgaccggtccaaggtgctctacttcaaccgccagaccgtcggccagtaccagatggccgagctgaacaagaaccccaacatgagcctgcggaacatggtgttctaccgccaggactacctcgacgagttcaacgtgatctgggagaagcaggccgagttccacaaggagctgacgcccgagctgaagaaggagatccgcgacatcatcatcttctaccagcggcgcctcaagagccagaaggggctgatctccttctgcgagttcgagaaccgggaggtcgtggtggagaaggagggcaagaagcagaccaagatcatcgggtgcaaggtcatcccgcgcagccaccccctgttccaggagttcaagatctggcagaccctcaacaacatcgaggtgttcgtcggcgagaagaaggggaagcggaagaagtccaacgtgagctccgacctgttcggcgacaccgaggacgcgctgatcacggagggccgccggttcctgtaccaggaggagaagaagatcctcgccaaggagctgagcatcaagaaggggctgaccaaggccgagatcctccgcctgctgttcgagaacccccaggagctcgacatcaacttcaagcagatcgacggcaaccagaccgggttcgccctgttctccgcctacagcaacatgatcgagaagtacggctacgagcccctggacttcaagaagccggcggaggacctcatctcccagctgaagaccgtgttcacggacctggggtggaacaccgacctcctgttcatcgacctggacaaggagaacaaggagtgggagaagcagccctacttccggctctggcacctcctgtacagcttcgagggcgacaacacccccaccggcaacgggaagctcatcgagaagatcatgcagctgtgcggcatcgagaaggagtacgccatcgagctggccaacgtctccctccaggacgactacgggagcctgtccgccaaggccatcaagaagatcctgctctacctgaaggagggcaaccagtacgacatggcgtgcgagtacgccgggtaccgccacagcaagtccagcctgacgaaggaggagatcgagaacaaggtgctcaaggacaagctggagatcctgcccaagaactccctccggaacccggtggtcgagaagatcctgaaccagatggtgaacgtgatcaacaccgtcatggaggtgtacggccgccccgacgagatccgggtggagctggcccgcgagctcaagaagtccgccaaggagcgggaggagctgaccaaggcggtcgccaagaacacccgcgagcacgaggagatccggaaggtgctgcagagcgagttcggcatgatcaacgtgagccgcaacgacatcatccggtacaagctctacgaggagctgaaggacaacgggtacaagacgctgtacagcaaccagtacatcccccgcgagaagctgttctccaaggagatcgacatcgagcacatcatcccccagagccgcctgttcgacgactccctgagcaacaagaccctcgagtacaagtccatcaacatcgagaagggcaacaagaccgcctacgacttcgtcaaggagaagtacggggaggagggcctgcagcagtacctgaaccggtgcgagaacctctgcaaggacaagaaggccaagctgcgcaagctgaagatggagctcaacgagatcccggacggcttcatcgaccgggacctgcgcaacacccagtacatcgccaagaaggcgctgagcatgctcacggagatctgccggcgcgtggtggccaccaccgggtccatcaccgacaagctgcgggaggactggcagctggtcgacgtgatgaaggagctcaacctgcccaagtacgaggccctgggcctcgtggaggtctacgaggacaaggacgggcgcaagatcaagcggatcaaggactggaccaagcgcaacgaccaccggcaccacgccatggacgccctgacggtggcgttcaccaaggacgtgttcatccagtacttcaacaacaagaacgccgcctgggagagcgactccaaggagcacaccaacatcgtcggcatcaagacccgctacttcgagagcgggaaggccgtgccgcccatccccctgggccagttccgggtggaggccaagtgccacctcgagaacctgctggtctccatcaaggcgaagaacaaggtggtgacgaccaacgtcaactgcatcaagaagaagggcgggacctacaagaacacccagcagacgccccgcggccagctccacctggagaccatctacgggagccacaaccagtacgtgaccaagatcgagaaggtgaacgcctccttcgacgccgtcaagatcgccaccgtgagcaagcaggactaccggaacgcgctgctcaagcgcctggaggtgttcggcaacgaccccaagaaggccttcacggggaagaactccctggagaagaaccccatctacctcgaccgggcccagaccatccaggtcccggacaaggtgcagaccgtggagctggagaccgcctacacgatccgcaagcccgtcgaccccaccctgaacgtggacaaggtggtcgacaagaagatccggctcatcctggagcagcgcctgaaggagtacggcggcgacgccaagaaggcgttcgtgaacctcgacgagaaccccatctggctgaacgaggagaaggggatcagcatcaagcgggtgaccatccgcggcatctccaaggcccaggccctgcacgacaagaaggacaaggacgggaacttcatcctcgacgagaccggcaagcgcatcccggtcgacttcgtgaacacggggaacaaccaccacgtggccatctaccggaagcccgtcctggacaagaagggccaggtgatcttcgacgacgagggcaaccccatgtacgagctggacgaggacgtggtcccgttcttcgaggccgtgacccgcgcgaacctcgggatccccatcatcgacaaggactacaagaagtccgagggctggcagttcctgttcagcatgaagcagaacgagtacttcgtcttccccaacgagaagaccgggttcaaccccaaggaggtggacctgctcgacccggacaactacgccatgatcagccccaacctgttccgggtgcagaagatcggcctgaacgactacaccttccgccaccacctcgagacgaccatccagaacgacctgaagttcatcacctggatccggtgcggcaagagcgggatcaaggacatcgtcaaggtgcgcatcaaccacatcggccagatcgtgtccgtcggggagtactga

SEQ ID NO: 2214 - RNA, 4332 nt, synthetic construct
  misc_feature 1..4332: note = Cas9 variant
  source 1..4332: mol_type = other RNA
atgaagaagatcctgggcctcgacctggggaccgccagcatcggctccgcctacgtgctggaggcggagaagtccgccgaccagaccaagatcgtctacctcgggacgcgcatcatcctgtccagcgccgacgccgagaacttctccaagggcctgagctgctcccccaccaccgaccggaccttcaagcgcagcatgcggcgccggctccagcgctacaagcagcggcgctccagcctgatccagcagttcaagaagatcgggatcatcacgaacaccgagcagatcatccgggagccgatctccgagacccacgagctgctccgcatccggagcaaggccgtgtccgagcacgtgagcctggaggagttcgcgcgcatcctgctcaccatcaacaagcggcgcggctacaagtccaaccggaagacgagcaagtccaccgaggaggacggcaagctggtcgacgccatggccgtgaccaaggagctgatcaagctcaagaagacccccgggcagtacatgttcgagcgcttcaagcggggcaagtacgccgagatcgacttctaccccttcgacctgatcaacgagctgaagcagatctgggaggtgcaggggcagaagtaccccgacgtcctcacggagggcctgctgagctccctcctgaagcagaagaccgggaaggcgaaggagctgatctacagcaagagcgacctcaacccggccgaggtgcccatcgactaccagaagggcaagaagctgcgcaagaccatcctgaacaagtacttcgcctacgagtcccggagcctcgccgtgaccaacatcatccccgtcgagcaggccatcacggcgatcgtggccatctgcaagcagatcaacaactccagcggctacctgggggccatcggcgaccgctcccgggtgctgtacgccaacaaccagaccatcgggcagtacctctacgagcgcatcaaggccaacccccacgaccgcatccggggcgaggtcttctaccgccaggactacctggacgagttcgaccggatctgggagtgccagcagaactactacccggcgatcctgaccaacgaccgcaagcagtacatccggaaccgcatcatcttctaccagcggcccctcaagagcaagaagtccgagctggccttctgcgagttcgagagccgcgaggtggagcacaacggcaagaagtacaccgaggggctgcacgtggcccccaagtccagccccgtcttccagcacttccggctctggcagcgcctgggccagatcgaggtgtccccgctgcggaagtgggacaagcagagcaacgagctgttcgagcagcagaacaacgccgaccgcgaggggatcctcaacacggaggccaagcagaagctgttctcctacctcaacctgctggaccacctcaccgacaacgagatcctgaacatcctgggctacagccccgacaagtggaagatcaacttccgggagatcatcgggaaccgcaccaacaacctcatgatgaaggcgttcttctccatgaaggagatgaccgacggcgagcagatcgactgggagaagaacctgacgaagatcaccaacggccagagcctgatctcccccgagcagatcgtggacctgatccggcagttcttcgagcgcgaggggatcaccaccagcctcctgtacttcgaccccgccacggacaacttccgggagcagtcccactacagcctgtggcacctcctgtacagctacgaggacgacaactccccgaccggcaccaccagcctgtgcaagacgctcgccaagcgctacgggatcccccacgagctgtgccccctgctcgcctccctgaccttcgagcggcagtacggcagcctgtccaccaaggccatgcgcaagctcctgcccttcatgcaggagaagcgctacgacgaggcgtgcgagctggccgggtaccggcacagcgcctggatcaccaaggaggagaacgccaagcgcacgctcaagaacaagctgccgctgctccggaagggctccctgcgcaaccccgtcgtggagaagatcctgaaccagatgacccacgtgatcaacacccacatcgcggagtacggcaaccccgacgagatccggatcgagatggcccgcgacatgcaggccaacagcaagcagcggaaggccatgaccgccgcgatcaccgaggccacgaagcgcaacacccagttcatcgaggagatccagaaggagttcgggttcaacccctccaagaacgacctcatcaagtacaagctgtggaaggagctggccccgctcggcaacaagaccctgtacagcaacatctacatccccaaggaggagctgttcaccgccaagttcgagatcgagcacatcatcccccgggccctcttctacgacgactccttcagcaacaagacgctggagctgaactccgtcaacaagctcaaggggaacaagaccgcgctggactacctggacaccctcggccaggagaaggccaacgactacatcctgcgcgtggaggagctgaagaagatcggggccatcacccaggccaagtacaagaagctcctgatccgggagaaggacctgggcgacgacttcacgaaccgcgacctcaccaacacccggtacatcatccgccacgccgcggaccgggacctgaccaacacgcgctacatcatccggcacgccgccgacatgctgctccaggtgacccccagcatcgtccacaccaacggctccatcaccgccatcctgcgccgggactgggggctgctcgacatcctgaaggagctgaacctcccgacgtacgagagcatcgaccgcaagatctccgaccccgaggagaagctgacccagagcgtggaccggaaggacggccaggcgatcaagatgatcaaggactggagcaagcgcgacgaccaccgccaccacgccatggacgccctgatcaccgccctcaccacgcggaagcacgtccagtacctgaacgggaactccggcgccgaggagaccgacaaggcgcagaagctggagcagctcaaggccctgcgcaagcagctgatcggcagcgacgggcacttcatcccgcccatgcacgacatccgggtgcaggccaaggaggccctctcccgcgtgatcatcagcaccaaggtcaagggcaaggtgaccacgcccaacaccaacatcatctgctcccgggacaagaccaccgggcgcaagatctacgtgcggcagacgaccctgacgccccgcggcgccctgcacctcgacaccaagtacgggatcaaccggtactaccaggagcgcgaggtcagcatcggctccaagctgacccaggaggagatccggctggtgagcagcccccacatccagagcatcctcctggagcgcctgcgggcgttcgacaacaacccgaagtccgccttcaccggccgcaacagcgtggacaagaagcccctcgaggacaagaacaagaagctggtctacaccgacaagaaggtgaagcagaccatcctggccaaccggttcgtgaagcgcgaccgggtcaactccaagctcgacctggacaacgtgatcgacacggggatcaagcgcatcctggagcggcgcctcaagcagtacggcgggaagtacgagaccgccttcagcgacctggagaacaaccccatctggctgaacgaggagaagggcatcgccatcaagtccgtgcgcatccgggggaagaacaacaccatcaccatccgccagaccaacacgtgccggatcaagtacgtcgcgaacgacaacaaccaccacctcgccgtgtacgccctgcccgacggcagcatcaaggacgacatcgtgtccttcttcgacgccgtcgagcgcagccggaagcgcctgccgatcatcgacaagcacaagaaccagtccctcggctggaagtacctgttcagcatcaagcagaacgagtacttcctgctcccccagcaggtcgagaagatcgacatcgacaccggggagatcagcatgcagaccaccttctcccccaaggacctgagccacgagtacatcatgaaccccgacaactacgcggagctggcctcccacatcttccgggtgcagagcatctccaagacgccgcagggcaaccgcgacgtgcggatctacctcttcaagcagcagtacatcagcgggtcccagaaggacagcctgcacctgaagggcatcacccaccgccagatctccagcgccaaggacctcgccgagctggtgaagatccgggtgaaccacctggggcgcatcgtctccgtgggcgagaagtga

SEQ ID NO: 2215 - RNA, 4341 nt, synthetic construct
  misc_feature 1..4341: note = Cas9 variant
  source 1..4341: mol_type = other RNA
atggtgaagaacatcctgggcctcgacctggggaccaacagcgtcggctgggccctgatcaagcaggacttcgagaacaagcagggggacatcctcggcatggggtcccgcatcatccccatgagccaggacgtgctgggcgacttcggcaaggggaactccatcagccagaccgccgagcggacgaagtaccgctccgtgcggcgcctgcgggagcgcttcctcctgcggcgcgagcggctgcaccgcgtcctcaacgtgctggacttcctgccggagcactacgcgagccagatcgacttcaacaagcggttcggcaagttcaaggaggagaccgagcccaagctcgcctactccaacgacgggttcatcttcaagaagtccttcgaggagatgatcagcgacttcaagacccaccagcccgagctgctggagaacaacaagaaggtgccctacgactggaccatctactacctccgcaacaaggccctgagccacaagatcgagaaggaggagctggcctggatcctcctgaacttcaaccagaagcggggctactaccagctgcgcggggaggaggaggaggagaacccgaacaagctcatcgagttctactccctgaagatcgtcgacgtgctggccgacgagccccagaagggcaagagcgacatctggtactccctcatcctggagaacggctggatctaccggcgcagctccaagatccccctgctcgactggaaggggaagacgcgggacttcatcgtgaccaccgacctgaacgacgacggcagcgtcaagaccgacaaggaggggaacgagaagcgctccttccgggcgcccggcgagaacgactggacgctggtgaagaagaagaccgagcaggagatcgacaacagcgacaagaccgtgggcgcctacatctacgaggccctcctgcagaacccgaagcagaagatcaaggggaagctggtccgcaccatcgagcggaagttctacaaggccgagctcaagcagatcctggagaagcagatggagttccaccccgagctgcgccaggacgacctctactccgactgcgtgcgcgagctgtacaagaacaacgaggcgcaccagctgacgctcagcaagaaggacttcgtgcacctgttcatggaggacatcatcttctaccagcggcccctgcgcagccagaagtccagcatctccaactgcaccctcgagttccggaagtacaaggacgagaacggcaccgagcacatccagtacctgaaggccctgcccaagagcaacccgtactaccaggagttccgcatctggcagtggatgtacaacctcaacatctacaagaaggaggacgacaccaacgtcacgaaggagttcctgaactccaaggccgacttcgagagcctgttcgagttcctcaacaacaagaaggaggtggaccagaaggccctgctgaagcacttcaagatcaacgacaagacccaccggtggaagtacgtggaggacaagaagtacccctgcaacgagaccaagaccatgatctccgagcgcctgaagaaggtcgagaacatcagcgacgacttcctcacgcgggagatggagcagaagatctggcacatcatctactccgtgaacgacaaggtgaagtacgagaaggccctcaagagcttcgcggagaagaacaacctggacgagtccagcttcttcgaggccttcaagaagttcccgcccttcaagtccgagtacggggccttcagcgagaaggccatcaagaagctcctgcccctgatgcgcctcggcaagtactgggacgacgacgagatcctgaagtactccgacatctacttcaagaacatcgagtacctgctcggggtcctgaagcagaaggacaagaacatcagcgacgacaaccggcagaactggaacaagtccatcaacaacaagctgcgcgaggagctcgagatcttccagaacgccgagatcgagagcttccagggcctgcggctgcacatcgcgcagtacatcctctacggccgccactccgaggccgccatgctggggaagtggaacagcgccgacgacctggaggagttcctcaaggagttcaagcagcacagcctgcggaaccccatcgtggagcaggtcatcaccgagaccctgcgcgtggtgaaggacatctgggtcaagtacggcaacggggccaaggacttcttcaacgagatccacatcgagctcggccgggagatgaagctgcccgcggaggaccgcaagaagatcaccaaccagatctccgagaacgagaacacgaacctgcggatcaaggccctcctggccgagatgatggtggacagctccgtggagaacgtccgccccttcagcccgatgcagcaggagatcctgaagatctacgaggacggggtgctcaactccgacatcgagatcgaggacgacatcctgaagatcagcaagaccgcccagccctcccccagcgacctgaagcggtacaagctctggctggagcagaagtacaagtccccctacaccggccagatcatcccgctgaacaagctgttcacccccgagtacgagatcgagcacatcatcccccagagccgctacttcgacgactccttcagcaacaaggtgatctgcgaggccgcggtcaacaagctgaaggacaacttcatcggcctggggttcatcaagcagttcggcgggacgatcgtggagtgcggcaacgggaagtccgtgaccgtcctcaaggaggaccagtacgaggacttcgtgaagaagcactacgccaacaaccgcagcaagcggaacaagctgctgctcgaggacatccccgagaagatgatcgagcgccagatgaacgacacccggtacatctccaagtacatcagcggcgtgctgtccaacatcgtccgcaccgaggacggcacggacgacggggtgaacagcaagaacatcgtgccgggcaacgggaagatcaccaacaccctgaagcaggactggggcctcaacgacatctggaacgacctgatcctgccccggttcgagcgcatgaaccagctcaccaacagcacggacttcaccgcctggaacgagaaccaccagaagttcctgcccaccgtcccggtggagttctccaagggcttcagcaagaagcggatcgaccaccgccaccacgccctggacgcgctcgtgatcgcctgcgccaccaaggaccacgtcaacctgctgaacaaccagtccgccaagagcgacaccaagcggcacgacctcaagcgcaagctgatgaagttcgagaaggtggcctacaaccacccccagacgggggagcggatcgagcgcgaggtgcccaagcagttcctgaagccctgggagaccttcaccgtcgaggcgaagaacggcctcgagaccatcatcgtgtccttcaagcagaacctgcgggtgatcaacaaggccacgaaccactacgagaagtacgtcgagaaggacggggccaaggtgaagggccgcgtggagcaggccgggaccaactgggccatccggaagccgatgcacaaggagaccgtcagcggcaagatcgacctgccccgcatcaaggtgcccaagggcaagatcctcaccgcgacgcggaagaacctggacacctccttcgacctgaagaccatcgggagcatcaccgacacgggcatccagaagatcctcaagaactacctgcagtacaaggacaacaaccccgagctggccttctccccggaggggatcgaggacatgaacaagaacatcgagaagttcaacgacggcaaggtgcaccagcccatcatcaaggtccgcatcttcgagctcgggagcaagttccccctgggccagtccggcaacaagaaggacaagtacgtggaggccgccaaggggaccaacctgttcttcgccgtgtacgaggacaagaacggcaagcggagctacgagaccatccccctcaacgaggtcatcgagcgccagaagcaggggctgaccgtggtggacctgaagggcgtcaacgacttctacctctccccgaacgacctggtgtacgtgcccagcgaggacgagctggagaacgtctccatgatcgactacaacaagctcagcaacgagaaggtgtacaaggtggtctccttcacggggaaccagatcttcttcgtgcggcaggacgtggcgaccagcatcgtcaacaaggccgagttctccagcctgaacaagatggagcgcgccatcggcggcaccatgatcaaggaggtgttcgtgaagatcaagatcgaccgcctggggaacatcagcaaggtctga

SEQ ID NO: 2216 - RNA, 4347 nt, synthetic construct
  misc_feature 1..4347: note = Cas9 variant
  source 1..4347: mol_type = other RNA
atgaagcacatcctgggcctcgacctggggaccaacagcatcggctgggccgtggtcaaggaggcccagaacgacaacgagcagtccgagatcgtggacgtgggggtccgcgtgaaccccctgaccacggacgagaagaccaacttcgagaagggcaagccgatcagcaccaacgcggaccggaccctcaagcgctccgcccggcgcaacctgcagcggtacaagctgcgccggaaggagctcatcgagctgctgaaggagcaccagctcatcagcgagaacacgatcctgaccgagaacgggaagggcaccaccttccagacgctggagctccgcgccaagtccgccaaggagaagatcagcctgggcgagctggcccgggtgttcctcaccatcaacaagaagcgcgggtacaagtccagccggaaggcgaagaacggcgacgaggggcagctgatcgacggcatggagatcgccaagcgcctgtacgaggagaacctcaccaccgggcagctgtccctgcagctcctgaaggagggcaagaagtccctgcccgactactaccggagcgacctccagttcgagctggacaaggtctggaacttccagaagcagagccactccgacatcctgacggacgagttctacgcccagctcaagggcaaggggcagcgcgccaccagcgcgctgttcctggccaagtaccagatctacaccgccgagaacaagggctcccgggaggacaagaagctccaggcctaccagtggcgcgtggacgccctgagcaaggagctgacccgggaggagctcgcgttcgtgatcacggagatcaacaacaacctgaacaactccagcgggtacctgggcgccatctccgaccgcagcaaggagctctacttcaacaacgagaccgtcggcgagtacctgtggaagcagatcgccgccaacccccacaacagcctgaagaaccaggtgttctaccggcaggactacctcgacgagttcgagcagatctggaagacccagtccgccttctaccccgagatcctgaccgacgagctgaagaaggagctccgcgacgtggtcatcttctaccagcggaagctcaagagccagaagtccctggtgagcttctgcgagttcgagaacaaggagatcgagatcaagaacgaggacgggacgaccaccaagaaggtgatcggcctgaaggtcgcgccgaagtccagccccctgttccaggagttcaagatctggcagaacctgaacaacgtgctcatccgcaagaaggggtccaagaccaagaaggtggccaagaaccagcaggccgtcctgttcgaggaggagaagacgatcagcgagctggacctggaggccaagcaggccctcttcaacgagctgaacctgaagggcaacctcaaggcggactactgcctggagatcctggggtactcccccaaggagtgggagatgaactacagcatcctcgagggcaaccgcaccaacaaggccctgtacgaggcctacctgaagatcaccgacctcgagggctacgacgccaagaaccacctgaaggtgaagctgaacaaggacgaggtggagctcgacgacctgaaggtccccgcctccgagatcaaggacatggtgcaggcgatcttcaaggaggccgggatcaacaccgacatcctgcacttcaacgccgagctcgacggcaaggacttcgagaaccaggccagctaccagctgtggcacctcctgtactcctacgagggggacgacagcaagtccggcaacgagctgctgtacaagctcctggagacgaagttcgggttcaagaaggagtacgcgcagatcctggccaacgtgagcctctccgacgactacggcaacctgagcaccaaggccatgcgggagatcatcacccacctgaagcagggcttcccgttcaccgggcgcaaggaccggcccgacgagccctccgcctgcgagttcgccggctacaagcacagcaagcacagcctcacgaaggaggagaacgagaagcgcgtcctgaaggactccctggaggtgctcaagaagaacagcctgcggcagcccgtcgtggagaagatcctgaaccagatgatcaacctcgtgaacgcgctgctgaagaagtaccgcaccgagaacccgaacttcaagttcgacgagatccggatcgagctcgcccgcgagctgaagaagaaggccgaggagcgggccaacatgaccgccaacatcaacaaggcgaagaccgagcacgagaagatcatcaagatcctgaagaacgagttcgggctccccaaccccacgcgcaacgacatcatccggtaccgcctgtacgaggagctgaaggacaacggctacaaggacctctacaagggggactacatcccccgggagaagctgttctccaaggagatcgacatcgagcacatcatcccgaaggcccgcgtcttcgacgacagcttctccaacaagaccatcacctaccggaagaccaacctggagaagggcgagcgcaccgcctacgactacatcgagagcctcggcgagaagcagctggaggagttcctgtcccggatcgagaacctctacgagatcgggaagcccagccgcctgcacaaccggcgcaaccccctgaagaaggtggaggagaagggcatctccgacagcaagtacaagaagctcctgaagaaggagtccgagatcggggacggcttcgtggagcgcgacctgcgggagacgcagtacatcgccaagaaggccaaggagatcctcctgcagatcacccgcagcgtcctgtccaccagcggcgggatcaccgaccggctccgcgaggactgggacctgatcaacgtgatgaaggagctgaacctccccaagtaccgggcgctgggcctgacgaagatggaggaccgcaagtacgggcagcaggtcgaggtgatcaccgactggaccaagcggaacgacctccgccaccacgccatggacgccctgaccgtggccttcacgaagcacaaccacatccagtacctgaactacctcaacgcgcggaagaacgagaagcacaaggagcacaacaacatcatggccatccagcagctggagaccatcaaggtgaccgacgagaacggcaacgagaagcgcatcttcaaggccccgatgcccaacttccggcaggtcgccaaggccttcctggagaacgtgctcatctcccacaaggcgaagaacaaggtggtcaccaagaacaagaacaagatcagcgggaacaacaaggtgcaggaggtgctgacgccccgcggccagctgcacaaggagaccatctacggcaagtaccagtactacgtccagaaggaggagaagatcgggggcaagttcgacctcgagaccatcgagaaggtggccaaccccctgtaccagtccctgctcaagaagcggctggaggagaacgggggcgacccgaagaaggccttcaccgggaagaacagcctggccaagaaccccatctacctcgacgaggcccagacggagcagctgcccgagaaggtgaagctggtctggctcgagaacagcttctccatccgcaaggacatcacccccgagaacttcaaggacgagaagctgatcgacaagatcctggacgagggcgtgaagcggatcctcaaggagcgcctgcagagcttcggcaacgacgcgaagaaggccttctccgacctggagaagaacccgatctggctcaacaaggagaaggggatcgccatcaagcgggtgaccatcagcggcgtcgccaacgccgagcccctgcacaccaagaaggaccacctggggaaggagatcctcgacaaggagggcaagcccatcccggtggacttcatctccacggggagcaaccaccacgtggcggtctaccgcgacgagaagggcaacctgcaggagaaggtggtgtccgtcttcgaggccgtggtgcgggccaaccagggcctgcccatcatcgacaagacctacaaccagtacctcgggtgggagttcctgttcagcatgaagcagaacgagatgttcgtcttccccaacgagtccaccggcttcaaccccaacgacatcgacctgctggacccgaagaacaagaagatcatcagccccaacctcttccgcgtgcagaagctggccaccggggactactggttccggcaccacctggagacgaccgtggagaccaagtccgcgaccaaggacatgacgtacaagcgcctcagcctgaaccacatcaagaacatcatcaaggtccgcatcaaccacctgggcgacatcgtgtccgtgggggagtactga

SEQ ID NO: 2217 - RNA, 4353 nt, synthetic construct
  misc_feature 1..4353: note = Cas9 variant
  source 1..4353: mol_type = other RNA
atgaagcacatcctgggcctcgacctggggagcaactccatcggctgggccttcgtgcagcaggacttcgagaacaagcaggggaagatcatcgccaccggcagccgcatcatccccatggaccaggggatcctgggcgacttcgagcggggcaacaccgtctcccagacggcggagcgcaccacctaccggaacacccgccggctccgcgagcggcacctcctgcgccgggagcgcctccaccgggtgctgcacatcctggggttcctcccgccccactacgacagccagatcgacttcacgaagcgctacggcaagttcatcgacaacgccgagcccaagatcgcctacaacaacgggaacttcatcttcatgaactccttcaacgagatgatcgaggacttcaagaagtaccagccccagctgttctacaagaagtccaacggcgaggagtccaagatcccgtacgactggaccatctactacctgcggaagaaggccctcagccagaagatcacccagcaggagctggcctggctgatcctccacttcaaccagaagcgcgggtactaccagctgcggggcgaggaggagaccgagaaccccaacaaggaggtggcgttccactccctggaggtcgtggacgtggaggccgaggcccccaacaagaagggcgagatctggtacacgatccgcctcgagaacgggtggatctaccggcgcaccagcaagatccccctggacgactggaagggcaagacccgggacttcatcgtcaccacggacctgaacgacgacgggaccatcaagctcgacaaggagggcaaggagaagcgctccttccgggccccggacgagaacgactggaacctgctgaagaagaagaccgagcacgacatcgacttcagcggcaagaccgtgggggcgtacatctacgaccacctcctgcagaaccccaaccagaagatcaagggcaagctggtgcgcacgatcgagcgcaagtactacaaggacgagctcaaggccatcctggccaagcagatcgccctgcagcccgagctgttcaccgagaccctgctggccgactgcatccgggagctctaccgcaagaacgagacccagcagcagaacctgctgtccaaggacttcctccacctgttcgtcgaggacatcatcttctaccagcggcccctgcgcagcaagaagtccacgatcgcgaactgcaccctcgagaagcggagctacatcgacaaggagaccaacgagcgcaaggacaccccgatcaaggtgtgcgccaagtccaacccctactaccaggagttccgggtgctgcagtggctgcagaacctccgcatctacgagatcgagacggaccgggaggtcaccgccgagttcatcgagaccgcccaggacaacgaggccctgttcaacttcctgatgagccagaaggagatcgacaacgagtccctcctgaagtacttcctgttcgcgaagaacccccagatcaaggacaaggtggccaagagcgagctcaagaagtggctgaccacgtaccgctggaactacgtgtacgacgccgccgacaacagctccaagaagtaccccatgaacgagaccgggtacgagctgcagcagtacctgcagaaggtcgagggcctcccggccaacttcctgaccttcgacatcacctaccggctgtggcacctcctgtacagcgtgaaggacaaggtggagttcgagaaggcgctgaagaagttcgcccaggagtaccagctcgacgaggcctccttcgtcgacagcttcaagaacttcaagccctaccccaacgagtacgggtccttcagcgagaaggccatcaagaagctgctgcccctcatgcgcttcggcaaccactgggacttcaaccggatcgacgtgtccacgcagaagcgcatcgacgacctgatcaacggcgtggccaacgacgagatccggaccatcatccgcgagaaggcggagaagtaccagctgaacagcgagacctgcttccaggggctcccgctgtggctggcccagtacgtcgtgtacaaccggcacgccgaggccgcggacatcgagaagtggacctccgtgaacgacctcgaggcctacctggaggacttcaagcagcacagcctgcgcaaccccatcgtcgagcaggtcatcacggagaccctccgggtggtgcgcgacatctggcagcgctacggcgggggccaggccaacttcttcgacgagatccacatcgagctggggcgggagctgaagaagaccgccgaggagcgcaagcagctctccaaccggaaccaggagaacgagaacaccaacctgcgcatcaagaagctgctcgccgagctgaaggaggacgcgagcatccagaacgtgcggccctactcccccgtccagcaggagctgctcaagatctacgaggagggcgtgttcagcgccaccgacgaggtggaggaggacatccagaagatccgcaagaaggccgagccgacgacccccgagatccagcggtacaagctgtggctggagcagaagtacaagtccccctacaccggcgaggtcatcagcctcaccaagctgttcacggaggagtacgagatcgagcacatcatcccccagtcccgctactacgacgacagcctgtccaacaaggtgatctgcgagagcgccgtgaacaagctcaagaccaaccagctggggctggagttcatccagaaccaccacggcgagaaggtccggatcaccgccaacaaggaggtgaccatcttcacggaggagcagtacaaggagttcgtgaagaagcactacgcgaacaacagcgccaagcagcagaagctcctgctgaacgagatcccggagaagatggtcgcccgccagctcaacgacacccggtacatctccaagtacatcagcgagatcctgtccaagatcgtgcgcagcgacgagaaggacgagggggtgaactccaagaacatcatcccctgcaccggcaagatcaccacggccctgaagcaggactgggggctcaacgacgtctggaacgagctgatcctgccccggttcgagcgcatgaaccagctcacccagacccagctgttcaccagctacaacgaccggttccagaagaacctgccgacggtgcccatcgagtactcccagggcttccagaagaagcgcatcgaccaccggcaccacgccatggacgcgctcgtgatcgcctgcgccacccgcgagcacatcaactacatgaacaaccagcacgccctggacaagagcaaggacaagaaggagaagcagcagtcccggatcgacctgcgcaccatcctctgcgagaagaagaacaacaactggcagttcaagaagccctggagcaccttcacgcaggaggcgcaggaggccctggagcacatcgtcgtgtccttcaagcagaacctgcgggtgatcaacaaggccaccaactactacgagaagtgggaggagaagaacggcgtcctcgtgaagaagaaggtgaagcaggaggggaccaactgggccatccgcaagcccctgcacaaggagaccgtcagcggcaagatcgtgctggaccgcaagatcgggaaggacaagatcctcacggccacccggaagtccgtggacatcaccttcaccgagaagatcatcagctccatcacggacaccggcatccagaagatcctgctgaactacctcaagtacaagggcagcccggaggtcgcgttctccgccgaggggctggaggagctgaacaagaacatcgcccagtacaacgacggcaagaagcaccagcccatctacaaggtgcgcatcttcgaggaggggagcaagttccccctcggcgagaccggggccaaggccaccaagtacgtggaggcggccaagggcacgaacctgttcttcggcgtctaccaggggaagggcaagcggacctacgccaccatccccctgaacgaggtgatcgagcgccagaagcaggggctcccgagcgtgcccgagcggaacgagaagggcgagcccctgctgttctccctcagccccaacgacctggtctacgtgccgatggagggggagatcgccgagaccatcgacttcaacaacctgtccaaggagcagaaggagcgcatctacaagacggtgagcttcaccggcaaccagtgcttcttcgtccaggaggccgtggcgacccccatcgtgaacaagatcgagtacagccccctcaacaagatggagcgggacatcctgggcaccatgatcaaggaggtctgcatcaagctgaaggtggaccgcctcgggaacatcaccaaggcctga

SEQ ID NO: 2218 - RNA, 4353 nt, synthetic construct
  misc_feature 1..4353: note = Cas9 variant
  source 1..4353: mol_type = other RNA
atgaagcgcatcctgggcctcgacctggggagcaactccatcggctgggccttcgtggagcaggacttcgagaacaagcaggggaagatcatcgccaccggcagccggatcatccccatggaccaggggatcctgggcgacttcgagaagggcaacaccgtctcccagacggcggagcgcaccacctaccggagcatgcgccggctccgcgagcggcacctcctgcgccgggagcgcctccaccgggtgctgcacatcctggggttcctcccgccccactacgacgcccagatcgacttcaccaagcgctacggcaagttcatcgacaacgccgagcccaagatcgcctacaacaacgggaacttcatcttcatgaactccttcaacgagatgatcgaggacttcaagaagtaccagccccagctgttctacaagaagtccaacggcgaggagagcaagatcccgtacgactggacgatctactacctgcggaagaaggtgctcagccagaagatcacccagcaggagctggcctggctgatcctccacttcaaccagaagcgcgggtactaccagctgcggggcgaggaggagaccgagaaccccaacaaggaggtcgcgttccactccctgaaggtggtggacgtcgaggccgaggcccccaacaagaagggcgagatctggtacaccatccgcctcgagaacgggtggatctaccggcgcacgagcaagatccccctggacgactggaagggcaagacccgggacttcatcgtgaccaccgacctgaacgacgacgggacgatcaaggtggacaaggagggcaaggagaagcgctccttccgggccccggacgagaacgactggaacctcctgaagaagaagaccgagcacgacatcgacttcagcggcaagaccgtcggggcgtacatctacgaccacctcctccagaaccccaaccagaagatcaagggcaagctggtgcgcaccatcgagcgcaagtactacaaggacgagctgaaggccatcctcgccaagcagatcgccctgcagcccgagctgttcacggagaccctcctggccgactgcatccgggagctgtaccgcaagaacgagacccagcagcagaacctcctgtccaaggacttcctgcacctcttcgtggaggacatcatcttctaccagcggcccctgcgcagcaagaagtccaccatcgcgaactgcacgctggagaagcggagctacatcgacaaggagaccaacgagcgcaaggacaccttcatcaaggtctgcgccaagtccaacccgtactaccaggagttccgggtgctccagtggctgcagaacctgcgcatctacgagatcgagaccgaccgggaggtgacggccgagttcatcgagaccgccgaggactacgaggccctcttcaacttcctgatgagccagaaggagatcgacaacgaggggctgctcaagtacttcctgttcgcgaagaacccccagatcaaggacaaggtcgccaagtccgagctgaagaagtggctcaccacctaccgctggaactacgtgtacgacgccgccgacaacagcagcaagaagtaccccatgaacgagacgggctacgacctgcagcggtacctgcagaaggtggaggggctgcccgccaacttcctcaccttcgacatcacctaccgcctgtggcacctcctgtactccgtcaaggacaaggtggagttcgagaaggcgctgaagaagttcgcccaggagtaccagctggacgaggccagcttcgtggactccttcaagaacttcaagccgtaccccaacgagtacggcagcttctccgagaaggccatcaagaagctcctgcccctgatgcggttcggcaaccactgggacttcaaccgcatcgacgtcagcacccagaagcggatcgacgacctcatcaacggggtggccaacgacgagatccgcacgatcatccgggagaaggcggagaagtaccagctgaactccgagagctgcttccagggcctgcccctctggctggcccagtacgtggtctacaaccgccacgccgaggccaccgacatcgagaagtggacctccgtgagcgacctggagacctacctcgaggacttcaagcagcactccctgcggaacccgatcgtcgagcaggtcgtgacggagaccctgcgcgtggtgcgcgacatctggcagcagtacgggggcgggcaggcgaacttcttcgacgagatccacatcgagctcggccgggagctgaagaagaccgccgaggagcgcaagcagctgagcaaccggaaccaggagaacgagaacaccaacctccgcatcaagaagctgctggccgagctcaaggaggacgcctccatccagaacgtgcggccctacagccccgtccagcaggagctgctgaagatctacgaggagggcgtgttctccagcaccgaccaggtggaggaggacatccagaagatccgcaagaaggccgagcccacgaccccggagatccagcggtacaagctctggctggagcagaagtacaagtccccctacaccggggaggtcatcagcctgaccaagctgttcacggaggagtacgagatcgagcacatcatcccccagtcccgctactacgacgacagcctgagcaacaaggtgatctgcgagtccgcggtgaacaagctgaagaccaaccagctcggcctggagttcatccagaaccaccacggggagaaggtccggatcaccggcaacaaggaggtgaccatcttcacggaggagcagtacaaggagttcgtgaagaagcactacgccaacaacagcgccaagcagcagaagctgctcctgaacgagatccccgagaagatggtcgcccgccagctgaacgacacccggtacatctccaagtacatcagcgagatcctctccaagatcgtgcgcagcgacgagaaggacgagggggtgaactccaagaacgtcatcccgtgcaccggcaagatcaccacggccctgaagcaggactggggcctgaacgacgtgtggaacgagctcatcctgccccggttcgagcgcatgaaccagctgacccagacccagctgttcaccagctacaacgaccggttccagaagaacctgcccacggtgccgatcgagtactcccaggggttccagaagaagcgcatcgaccaccggcaccacgcgatggacgccctggtcatcgcctgcgccacccgcgagcacatcaactacatgaacaaccagcacgccctcgacaagaacaaggacaagaaggagaagcagcagagccggatcgacctgcgcaccatcctgtgcgagaagaagaacaacaactggcagttcaagaagccctggtccaccttcacgcaggagaccaaggaggcgctcgagcacatcgtggtgagcttcaagcagaacctgcgggtcatcaacaaggccaccaactactacgagaagtgggaggagaagaacggcgtgctggtgaagaagaaggtcaagcaggaggggaccaactgggccatccgcaagcccctccacaaggagacggtgtccggcaagatcgtgctggaccgcaagatcggcaaggacaagatcctgaccgccacccggaaggaggtcgacatcaccttcacggagaagatcatcagctccatcaccgacaccgggatccagaagatcctcctgaactacctgaactacaagggcagccccgaggtggcgttctccgccgaggggctcgaggagctgaacaagaacatcgcccagtacaacgacggcaagaagcaccagccgatctacaaggtgcgcatcttcgaggaggggagcaagttccccctgggcgagaccggcgccaaggccacgaagttcgtcgaggcggccaaggggaccaacctcttcttcggcgtgtaccaggggaaggagaagcggagctacgccaccatccccctgaacgaggtgatcgagcgccagaagcagggcctgccctccgtcccggagcggaacgagaagggggagcccctcctgttcagcctgtcccccaacgacctcgtgtacgtgcccatggagggcgagatcgccgagaccatcgacttcaacaacctgagcaaggagcagaaggagcgcatctacaagacggtctccttcaccggcaaccagtgcttcttcgtgcaggaggccgtggcgaccccgatcgtcaacaagatggagtacagccccctgaacaagatggagcgggacatcctcgggaccatgatcaaggaggtgtgcatcaagctgaaggtggaccgcctgggcaacatcaccaaggcctga

SEQ ID NO: 2219 - RNA, 4353 nt, synthetic construct
  misc_feature 1..4353: note = Cas9 variant
  source 1..4353: mol_type = other RNA
atgaagcacatcctgggcctcgacctggggagcaactccatcggctgggccttcgtgcagcaggacttcgagaacaagcaggggaagatcatcgccgcgggcagccgcatcatccccatggaccagaagatgctgtccaacttcgaggaggggaccaccgtcagccagacggccgagcggaccacctaccgctccatgcggcgcctccgggagcgccacctcctgcggcgcgagcggctccaccgcgtgctgcacatcctgggcttcctcccgccccactacgacgcccagatcgacttcaccaagcggtacggcaagttcatcgacaacgccgagcccaagatcgcctacaacaacgggaacttcatcttcatgaacagcttcaacgagatgatcgaggacttcaaggagcaccagccccagctgttctacaagaagtccaacggcgaggagagcaagatcccgtacgactggacgatctactacctgcgcaagaaggcgctctcccagaagatcacccagcaggagctggcctggctgatcctccacttcaaccagaagcgggggtactaccagctgcgcggcgaggaggagaccgagaaccccaacaaggaggtggccttccacagcctgaaggtcgtggacgtggaggccgaggcgcccaacaagaagggggagatctggtacaccatccggctcgagaacggctggatctaccgccggacgtccaagatccccctggacgactggaagggcaagacccgcgacttcatcgtcaccaccgacctgaacgacgacgggacgatcaagctcgacaaggagggcaaggagaagcggagcttccgcgccccggacgagaacgactggaacctgctgaagaagaagaccgagcacgacatcgacttctccgggaagcccgtgggcacctacatctacgaccacctcctgcagaaccccaaccagaagatcaagggcaagctggtgcggaccatcgagcgcaagtactacaaggacgagctcaaggccatcctggccaagcagatcgccctgcagcccgagctgttcacggagaccctgctggcggactgcatccgcgagctctaccggaagaacgagacccagcagcagaacctgctgagcaaggacttcctccacctgttcgtcgaggacatcatcttctaccagcgcccgctgcggtccaagaagtccaccatcgccaactgcacgctcgagaagcgctcctacatcgacaaggagaccaacgagcggaaggacacccccatcaaggtgtgcagcaagtccaacccctactaccaggagttccgcgtgctgcagtggctgcagaacctccggatctacgagatcgagaccgaccgcgaggtcacggccgagttcatcgagaccgcccaggactacgaggccctgttcaacttcctgatgagccagaaggagatcgacaacgagagcctcctgaagtacttcctgttcgcgaagaacccccagatcaaggacaagaccgccaagatcgagctcaagaagtggatcaccacgtaccggtggaactacgtgtacgacgtggccgacaactccagcaagaagtacccgatgaacgagaccgggtacgacctgcagcgctacatgcagaaggtcgagggcctgcccaccaacttcctgaccttcgacacgacctaccggctctggcacctcctgtactccgtgaaggacaaggtggagttcgagaaggccctcaagaagttcgccaagaagaagcagctggacaagaccagcttcgtcgactccttcaagaacttcaagccctaccccaacgagtacgggagcttctccgagaaggcgatcaagaagctgctcccgctgatgcgcttcggcaaccactgggacttcaaccggatcgacgtgagcacccagaagcgcatcgacgacctgatcaacggggtggccaacgaggacatccggacgatcatccgcgagaaggccgagaagtaccagctcaactccgagacctgcttccaggacctgcccctgtggctcgcccagtacgtcgtgtacaaccggcacgccgaggcgaccgacatcgagaagtggaccagcgtgtccgacctggaggcctacctggaggacttcaagcagcacagcctccgcaaccccatcgtcgagcaggtcgtgaccgagacgctgcgggtggtgcgcgacatctggcagcagtacggcggcgggcaggccaacttcttcgacgagatccacatcgagctgggccgcgagctcaagaagaccgccgaggagcggaagcagctgtccgacaagaaccaggagaacgagaacaccaacctgcgcatcaagaagctcctggcggagctgaaggaggacgccagcatccagaacgtccggccctactccctcgtgcagcaggagctgctgaagatctacgaggagggggtgttcagctccaccgacgagatcgaggaggacatccagaagatccgcaagaaggtcgagccgacgacccccgagatccagcggtacaagctctggctggagcagaagtacaagagcccctacaccggcgaggtgatctccctgaccaagctgttcacggaggagtacgagatcgagcacatcatcccccagagccgctactacgacgacagcctgtccaacaaggtgatctgcgagagcgccgtcaacaagctgaagaccaaccagctcgggctggagttcatccagaaccaccacggcgagaaggtgcggatcaccgccaacaaggaggtgaccatcttcacggaggagcagtacaaggagttcgtcaagaagcactacgccaacaactccgcgaagcagcagaagctgctcctgaacgagatcccggagaagatggtggcccgccagctgaacgacacccggtacatcagcaagtacatctccgagatcctcagcaagatcgtgcgctccgacgagaaggacgagggcgtcaacagcaagaacatcatcccctgcaccgggaagatcaccacggccctgaagcaggactggggcctgaacgacgtgtggaacgagctcatcctgccccggttcgagcgcatgaaccagctgacccagacccagctgttcacctcctacaacgaccggctccagaagaacctgccgacggtgcccatcgagtacagccaggggttccagaagaagcgcatcgaccaccggcaccacgccatggacgccctcgtcatcgcgtgcgccacccgcgagcacatcaactacatgaacaaccagcacgccctggacaagtccaaggacaagaaggagaagcagcagagccggatcgacctgcgcaccatcctctgcgagaagaagaacaacaactggcagttcaagaagccctggcggaccttcacgcaggaggccaaggaggccctggagcacatcgtggtgtccttcaagcagaacctgcgcgtcatcaacaaggcgaccaactactacgagaagtgggaggagaagaacggcgtgctcgtgaagaagaaggtcaagcaggaggggaccaactgggccatccggaagcccctgcacgaggagaccttcagcggcaagatctccctgaaccgcgagaaggtgggcaaggggaacatcctcacggccacccgcaaggccgtggacagctccttcgacgtcaagaagatcagcaagatcaccgacaccggcatccagaagatcctgctgaactacctcaagtacaaggggagcccggaggtggcgttctccgccgagggcctggaggagctgaacaagaacatcgcccagtacaacaacggcaagaagcaccagcccatctacaaggtgcggatctacgagaaggggagcggccgcttcgtcctcggggagaagggcacgaagtccaagaagtacgtgcagggggcccccaacctgtacttcggcgtgtaccagggcaaggagaagcggacctacgccaccatccccctgaacgaggtcatcgagcgccagaagcaggggctcccgagcgtgcccgagcggaacgagaagggcgagcccctgctgttctccctcagccccaacgacctggtgtacgtcccgatggagggggaggcgaccgagacgatcaacttcaacaacctgaacaaggagcagaaggagcgcatctacaagaccgtgtccttcaccggcaaccagtgcttcttcgtgcaggaggccgtcgccagccccatcgtgaacaagatggagtacagccccctcaacaagatggagcggagcatcgtggggatcatgatcaaggaggtctgcatcaagctgaaggtggaccgcctgggcaacatcaccaaggcctga

SEQ ID NO: 2220 - RNA, 4362 nt, synthetic construct
  misc_feature 1..4362: note = Cas9 variant
  source 1..4362: mol_type = other RNA
atgaagaccgtgctgggcctcgacctggggaccaacagcatcggctgggccctgatccagcacgacttcgactccaagaagggggagatcctcggcatggggagccgcatcatccccatgtcccaggacatcctgggcgagttcggcaaggggaacagcgtctcccagacggccgaccggaccaagttccgcagcgcgcggcgcctgcgggagcgccacctcctgcggcgcgagcggctgcaccgcgtgctcaacatcctgggcttcctgccgcggcactacgccgccgacatcgacttcgagaagcgcctcgggcagttcttcgagggcaaggagcccaagctggcctacgacaacaaccagttcatcttcaccaagtccttcgggaagatgctggccgacttccggcagcaccagcccgacttcctcaaggacgagaagtccaacgacctgctgatcccctacgactggagcatctactacctccgcaaggaggcgctgaccaagaagatcgagaaggaggagctggcctggatcatcctcaacttcaaccagaagcggggctactaccagctgcgcggcgaggaggaggaggagaacctgaacaagctcgtggagttccacagcctgaagatcatcgacgtcgtggccgacgagaagctgaacaacaagggggagacgtggtactccctcctgctggagaacggctggacctaccggcgcagctccaaggtgcccctcttcgactggaaggagaaggtccgggacttcatcgtgaccaccgacatcaacgacgacgggagcgtgaagacggacaaggagggcaacgagaagcgctccttccgggcccccagcgacgacgactggaccctgctgaagaagaagaccgagcaggacatcgacaagtcccgcaagcccatcggcgcgtacatctacgacgccatcctcaagaaccccaagcagaagatcaacgggaagctggtccgcaccgtggagcggaagttctacaaggaggagctgaagctcatcctgcagaagcagaaggagttccacccggagctgcagagcacggacctctacaacgagtgcatccgcgagctgtacaagaacaacgacgcccaccagctgcagctcaacaagaaggacttcgtgcacctgttcctggaggacatcatcttctaccagcggcccctccgctcccagaagtccagcgtcggcaactgccccctggagttccggaagttcaaggacagcgaggggatcgagaaggtggagtacctgaagaccatccccaagagcaacccgtacttccaggagttccgcatctggcagtggatgtacaacctctccatctacaagaaggacgacgacgagaacgtgacccgggacttcctgaagaccatcgaggactgggaggacctgttcgagttcctgaaccaccgcaaggacatcgagcaggagacgctcctgaagttcctgctcggcaagaacggggtcaagggcaaggccctgaaggtggaggccggcaagttccggtggaactacgtgagcgacaagatctacccctgcaacgagaccaaggcgctgatcatctccaagctcgagaaggtcaagggggtggaggagaagttcctgaccgaggagatcgagtacaagctgtggcacctcatctacagcgtgaccgacaaggtcgagtacgagaaggccctgaaggccttcgccggcaagcagaagctggacctcgtgtccttcgtggacagcttcaagcgcttcccgcccttcaagaacgagtacggggcctactccgagaaggcgatcaagaagatcctgccgctgctccggacgggcaagagctggaactggatggccatcgactccaaggtccgcgaccggatcaacaagatcatcaccggggagttcgacgaggagatcaagaacaaggtgcgcgagaaggccgagaagcacagcctgaagaaggagaacgacttccagggcctgcccctctggctggcccagtacgtcgtgtacggccggcactccgaggccagcttctccgggaagtggaacagcgtggacgacctgaagaagtacctcgaggagttcaagcagcactccctgcgcaaccccatcgtcgagcaggtcctgaccgagaccctccgggtggtggcggacatctggcagttctacggcaagggggagaaggacttcttcagcgagatccacatcgagctgggccgcgagatgaagaacacggccgaggaccggaaggagatgtccgccatcatccaggccaacgagaccaccaacctgcgcatcaaggccctcctgaacgagctgctccaggacaagaaggtggagaacgtgcgcccctacagcccgagccagcaggagatcctgaagatctacgaggacggggtcctgtccagcgacatcgagatccccgacgacatccagaagatctccaaggcggcccagcccaccaagagcgagctccagcggtacaagctgtggctggagcagaagtaccgctccccctacacgggcgccatgatcccgctcggcaagctgttcaccagcgagtacgagatcgagcacatcatcccccagtccctgtacttcgacgacagcttctccaacaaggtgatctgcgagagcgccgtgaacaagctcaaggactcccggctggggatggagttcatcaaggagtgccacggcatggtcgtggagaccgggttcggcaagagcgtgaccgtcttcgaggaggagacgtaccgcgacttcgtggtgcagaactactccaagaaccacagcaagaagtccaagctgctcctggaggagatccccgagaagatgatcgagcggcagatgaacgacacccgctacatcagcaagttcatctccagcgtcctgagcaacatcgtgcgggaggaggtgaacgacgacggcgtcaactccaagaacatcgtgcccgggaacggcaagatcaccacccagctcaagcaggactgggggctgaacgacatctggaacgagctgatcctcccgcgcttcgagcggctgaacgtgctgacggacagcaagcacttcaccgcgtggtccgagaaccaccagcgcctcctgcccaccgtccccatcggcctgagcaaggggttctccaagaagcggatcgaccaccgccaccacgccctcgacgccctggtgatcgcctgcgccagccggaaccacatcaacttcctgaacaacgcgcacgccatcgacaagaagaagaactccgaggagaagcagaagttccgccacgacctcaaggccatcctgtgcgacaagaagtacagcgacaagtccgagaagaactaccggtggatcttcaagaagccgtgggacaacttcaccatcgacagcaagaacgccctggacaagatcatcgtgtccttcaagcagaacctccgcatcatcaacaaggccaccaaccggtacgagaagtgggtcgaccgcgacggcatcaaggtgaaggagtggcacaagcaggagggcatcaactgggcgacgcggaagcccctgcacaaggacaccgtgagcgggaaggtcgacctgaagcgcgtgaccgtgcccgagggcaagatcctcaccgccacgcggaagtccctggacaccagcttcgacctgaaggtcatcgagtccatcaccgacaccgggatccagaagatcctcaagaactacctgacgagcaagtccaacaaccccgagctggccttcagctccgagggcgtggaggacatgaacaagaacatccgcaagtacaacgacgggaagctccaccagccgatctacaaggtgcgcatcttcgagctgggcagcaagttccccctgggccagttcgggaacaagaagttcaagtacgtcgagaccgccaagggcaccaacctcttcttcgccgtgtacgaggacgagaacaagaaccggaactacgagaccatccccctgaacgtggtcatcgagcgccagaagcaggggctgagctccgtgcccatcaagagcgagaagggccacaagctcctgttctacctgtccccgaacgacatcgtgtacgtccccgggagcaacgaggagttctccatcgaccggctctaccgcttcacggacagctccgacaagaccgcgaacttcatccccctgagcgtgtccagcctgatcttctccagcaacaagaacgagcagaagaagatcggcatctcctaccccatccaggacgagttcggcctcgggagcccgcagtccaagaaccagaagtccatcgacggcatcatgatcaaggagaagtgcgtgaaggtcaacatcgaccggctggggcgcgtgagcttctga

SEQ ID NO: 2221 - RNA, 4368 nt, synthetic construct
  misc_feature 1..4368: note = Cas9 variant
  source 1..4368: mol_type = other RNA
atggccaagatcctgggcctcgacctggggaccaacagcatcggctgggccgtggtcgaggaccagaacaacaagaccacgctgatcgacaagggggtgcgcatcttcagcgagggcgtgaagatcgagaaggggatcgagaagtccaaggcggccgagcggaccgacttccgcagcgcccggaagatcaagttccgccggcgcctccggaagcaggagaccctgaaggtcctgatcgagaacaacatgtgccccctcaccatcgaggagtggacgaagtggaagaaggacaagaaggagtacccgaagaaccccgacttcatcaactggctgaagaccgacgagctgaagaacatcaacccctacttcttccgcgacaaggccagccggaccgagctccccctgatgcagaccggccgcgccctgtaccacctcgcgcagcggcgcggcttcctgtccaaccggctggaccaggggagcgacggcttcacggagcagatccgcctcgacctgatcaagaagatcgagtgcgagaccgacaagaccgagctgctcacctccgtgcagagcatcatcgacacgtactccgaggaggaggacaaggacgccaagaagctgctgaagggggtggagaagctctgcaagatcaacaacgagctgccgatcaccgagttcaaggagaagctgatcaactacctcaacaaggccgacaacctgggcgccgtcaagaaggggatcgcggacgtgagcaagaagatcaccgagaccggctgcgagacgctgggccagtacttctacaagctctaccagaaccagtccaagatccggaaggtgtacaccgcccgcaccgagcactactaccacgagttcctgaagatctgcgagacccagaacatctgcgaccagctgaagcacaagctcgacaaggccatcttctaccagcggcccctcaagagccagaaggggctgatcggcaagtgcgtcttcgagaagaacaagacgcgctgcgccgtgtcccaccccgcctacgaggagtaccgggcgctccagttcatcaacagcatcaaggtgtccgagaccaaggacgggaagaaggacttcctgagcttcgacgagcgcaagaagatctggcccaagttcatccggaagtccaagccgaacttcgacttcaaggagatcgccgagaccctggacaagaagggcctcagccgctactacaactacaccggccacacgtccgtcagcgggtgccccaccatcgcccagctgaccaacatcttcggcgagaactggcaggagaccctgttcgagaagtacacgaacaagcagaacaccaaggggctcaagaccatcgacgaggtggtgaccgacatctggcacgtcctgttcacgttcgacaaggacgagaagatcatcgagttcggcaagcagaagctggggctcaacgaggtgctggccaagaagttcggcgccatcaacctgaagaaggactacgcgagcctctccctgaaggccatcaacaagatcctgccctacctccgcgagggcctgatctacagctacgccgtgttcctggccaacatcgagaacgtcgtgggggaggagatctggaagaacgacgagaacaagaacctgatcaagaaggagctccacctcctgatcgacaacttcaacgagatcaagggcctggaggccgtggtcaacgacttcatcgcggacttcaagaaggagtacaacaacgcccacaaggactacgtgctggacgagcaggacaagaagatcctgctcgagaagatcgagtccaactacgggaagaacaagttcgagagcctggagcccgacaagaagaccgagatcatcaactccaccgagaagatggtggccgagcagctgcggaagcagcgcggcgagttcatcaagccgaagcggctcgacgagaagatcagcgagttcctgatcaacaacttcaacgtcaccaagaagtccatcgcccgcctgtaccaccccagcgacgtggagatcttcaagacggcctcccggaacagcgaggggctcctgctgctcggctcccccatcgtcagctccatcaagaaccccatggcgatgcgcgccatgcaccagctgcggaagctggtgaacaccctcatcaaggagaacatcatcgacgaggagaccaagatcaacatcgagctggcccgcgagctgaacgacgccaacaagcgggcggccatcaagaagtggcaggacgagcgccagaaggcccgggaggagtacaagaagtccatcaaggagctgttcaaggccgagtgcggcaaggacatcgagccgagcgacagcgagatcctgaagtacgagctgtgggaggagcagcagcacatctgcatctacaccgggaagaccatcaacatctgcgacttcatcggcgccaaccccaacttcgacatcgagcacacgatccccaagtccctctgcttcgacaacagcaacgagaacctgaccctgtgcgacatccagtacaaccgcgacgtgaagcggaacaagatccccaccgagctctccgactacaacagcatcaagccgcgcctggacaagtggctggtcttcatcgacgactacgagaagctctacaacacccggaagaaggcgaaggggatcgagacgaaggagcagaaggacaagcgcatcaaggagaagcactactacaagctgcacctggactactggaagggcaagtacaagcggttcatcatggtggacgtgcccagcgggttcaagaactcccagatcgtcgacaccggcatcatcaccaagtacgccatcagctacatgaagtccatcttccccaaggtgtacagcgtgaagggcaacatcgtcgccgagttccgcaagatctgggggctccagaacgactacgagaagaaggagcgggtgaaccacgtgcaccactgcatcgacgccatcaccatcgcctgcatgtccaagcagaagtacgacacgctggcgaagatctaccacgaggacgaggccggcttccacaagatcaagaaggagacccagctggtcagcaagccctggacctccttcaccatggacgtgctcaacatcgagaaggagatcttcgtgagccaccacacgccggacaacatgaagaagcagtccaagaaggtcgtgcgcgagcgcgggatcatcgcccccaaggtgatctacgagaccgacgccaacaacaacaccctgcgggacaagtacggcaagaagatcgtcaaggagtacatcctgctcaaggacgtgaacggcaacctgatccccatcaaggggaagcgcctgacccccagcgacatcatcaacaaggtggacggcatcgactacttctccctcatcatcaacgacaagatccagtactacgagttcgccaagagcaagaagacggggaagatcatctacaagaaggagccgatctacctgcagggcgacaccgtccgggggtccctgcacctcgacaccttctacggcgcgatcgccaaggacatcaacggcaacatcatcaccaacacgaacgggaagatcgcccccaactacgtgatccgcaaggagctgagcaagctgaaggagaccgacatcgagaacatcgtggaccccgtcgtgcggggcaagatcatcgaggccaagaagaacaagctcatcaccttcaacaagtccggggcggtgatcaagaccacgatctggatgaaggagaaccagatcccgatcaacaaggtccgcgtgtacagctccctgaagaaccccctgcccgacttcaagaagcaccgggacctcagccacctgacctacaagcagcagtacaacgtgagcaacgaggagaactactgcctggccatctacgagggcaagaacaagaaggggaacgtctgccggacctgcgagctcgtgaacatgatcgacgccggcaactactaccgcctgtccaacaagaactggaagcagcagtaccccatcgtgccggagaaggacagcgtcaccaactactccctgaagacgatcatcaccaagggcctcatggtgctgctgtacgagaagtcccccgaggagatctgggagctcacctacaaccagcagatggagcgcctgtacgagatcacccagctggacacggagaagtccgccgagatcaagctcctgttccaccaggaggcccgggagaagaaggtgatcaccgagtacatggggctgaagaccggcatgaagggcgggaagaacatcgggaagcacaaggagttcccctggatcaaggtcggccccaacagcttcgacgcgctcatcgagggcatcgacttcaagctgaccccgacggggaagatcatcaagctgtga

SEQ ID NO: 2222 - RNA, 4374 nt, synthetic construct
  misc_feature 1..4374: note = Cas9 variant
  source 1..4374: mol_type = other RNA
atgaagaccatcctgggcctcgacctggggaccaacagcatcggctgggccaaggtgtccgtcgacgactacgggaactacctgcacgacatcaagctcggcagccgcatcatccccatgtcccaggacgtgctggggaacttcgacagcggcgtgacggtctcccagaccgcccagcggaccgagttccgcagcaagcggcgcctggtgcagcggaacctccagcgccgggagcgcctgcaccgggtgctgcacgtcctcgacttcctgccggcgcactacgacgccgccatcggctgggaccgcaccgaggccgtgacgtacgggaagttcctgaaccacgccgagcccaagctcgcgtgggaggagctgggcaacgggaagcggcgcttcctgttcatggactccttccacgagatggtggccgacttcgcccggtgccagcccgccctcgtcgcggacggcaagaagatccccctggactggaccatctactacctgcgcaagaaggccctcacccaggccatcaccaaggaggagctggcctggatcctgctcaacttcaaccagaagcgggggtactaccagctgcgcggcgaggaggaggaggagaacccgacgaagcaggaggagtactacgagctgaaggtggtgagcgtcgaggccaccgactcccggaagggcaacgacacctggtacaacgtgcacctcgagaacgggtggatctaccgccggagctccaagatcagcctggacgactgggtgggcaaggtcaagcagttcatcgtgaccacggagtacgagaaggacggggcgaccctgaagaccgacaaggagggctacgtgaagcgctccttccgggcccccaacgagaacgactggggcctccgcaagaagcgcaccgagacgctgctggagatgagcgggaagaccgtcggcgccttcatctacgaccacctcctgcaggagcccgccgacaagatccgggggaacttcatccgcaccatcgagcggcactactacaaggccgagctggaggcgatcctcgccgagcagtgcaagtaccacatcgagctgcgcgacaaggagatgctggaggcctgcgcccgggagctctacctgaacaacctgccccaccagcgctccctcatgaagaaggacatgacctacctgctgctctacgacctgatcttctaccagcggccgctcaagagcaagaaggccctgatcgcgaactgcccctacgagtactacgagtacgtggacaaggagacgggcgagatcaagcgccagaacatcaagtgcatcgccaagtccaacccctacttccaggagttccggctgtggcagttcgtgctgaacctccgcctgttcgaccgggtcgaggacaaggaggtgaccgccaactacctgcccaccgccgacgaccacgcccgcctgttcacctacctcaacgaccggaaggagatcaaccaggagacgctgctgaaggactacttcaagctcaagaaggtgaagatcgggaacgagaaggagtacccgatccgctggaactacatcgaggacaaggagaagaagtacccctgcaacgagacccggtacgagctgctgatggcgctcgaccgcgccggcatcgagcacaagtggctggacgacaacaacctggagtaccggctctggcacctcctgtacagcgtcgaggtgaagtccgagagcgagaccgccctgcgcaagctgaagaacgacgacgccttcgtcaacagcttcctgaaggtgaagcccttcaagaaggagtacggcgcgtactccgagaaggccatcaagcggctcctggccgtgatgcgcaaggggttcctgtggaacgagcaggacatctgcgacgagacccgcaagcggatcgagatcatcatcaagggcgacgtcgacgagaaggtgaaggagcgcatggggcacgccgcctacagcttcgaccgggtgtccgacttccagggcctccccgagtggctggcgtgctacgtcgtgtacgggcgccacagcgaggccatggacatccagcactgggactccccggagcggctgatggcctacatcaacaacttcaagcagtacagcctccgcaaccccatcgtggagcagtgcatcctggagacgctgcggaccgtccacgacatctggaaggagaccggccagatcgacgagatccacgtggagctcggccgcgagatgaagtccaccagcgaggagcgggcccgccggacgcagaacgtgctgcgcaacgagaacaccaacctgcggatcaagtccctcctgatcgagctgaagaacgacaccgacatctgcaacgtccacccctacagccccatgcagcaggagatcctccgcatctacgaggagggggccctgcaggagctgaaccgggaggacgaggacttcgaggagatctccaagatcagccagatgtcccagccgagcggcaaggagctcaaccgctacaagctgtggctggagcagaagtaccggtccccctacaccgggaaggcgatcagcctcgccaagctgttcacgcccgcctaccagatcgagcacgtgatcccccagtcccgctacttcgacgacagcttcaccaacaaggtgatctgcgaggccgaggtcaacaccctgaagtccaacctcctgggctacgagttcatcaagaagcacgggggcgagatcatccactgcaccaccctgggcgacgtgcggatcttcagcgagagcgagtacaaggccttcgtgatggaccactacgcgaacaacaagtccaagaaggacaagctcctgatggaggacatcccgcaggagttcctgagccgccagatgaacgactcccggtacatcagcaaggtcgtgaagacgctcctgtccaacatcgtgcgcatggccgacgagagcgaggccacctccaagagcgtcatcgtgtgcaccgggggcgtgaccgaccgcctgaagaaggactgggggctcaacgacgtctggaactccatcgtgtacagccggttcgagcgcctgaaccggctgacgggcaccgaggccttcggccactgggagaacaaggacgggaagcgcgtgttccagacctccatgcccctcgagctgcagcggggcttccgcaagaagcggatcgaccaccgccaccacgcgatggacgccctggtcatcgcctgcgccagccggaacatcgtgaactacctcaacaacgagtccgccaacaaccccaagaagcgcgaggacctgcggcgccagctgtgcgacaagaaccgggtgatccgcaagccctgggagaccttcacgcaggacgcgtacaacgccctcgagaacgtcgtggtgagcttcaagaactacgtccgggtgatcaacaaggccaccaaccgctacgagcactacgacgagaacgggaagaagcggttcgtgcagcagaagggctccgagctgtgggccatccgcaagccgatgcacaaggagacctactacgggcacgtcaacctgcggcgcaaggagctcgtgaccctgcagaaggccctggacgacatccccagcatctgcgacaagaagctccgcgactacatctccgcgctggtggagaagcacttcaacaagcggcagctgctcgcccacttcaagagcacggactactactggcagaagcagtacgtcaacaaggtgtacgtgtggaccttcagcgacgacatcaagcccctggtcgccacccgcaagctgctcgacacctccttcgacgccaagcggatcggcacgatcaccgacaccggcatccagaagatcctgcgcaactacctggaggccaagggcgggaacgcgaccctcgccttcacgccggaggggatcgccgagatgaaccagaacatcagcaagtacaacgacggcaagccccaccagcccatcctgaaggtgcggatcaccgagcccatgggggccaagtaccgcgtgggccagaccggcaacaagatggcgaagtacgtcgaggcccagtccgggaccaacctgtacttcgccatctacgaggacagcgagggcaagcggtcctacacgaccgtgccgctcgacgaggtggccgagcgcctgaagcagcggctgagccccgtccccgagaaggacgagaacgacgtgcccctcaagttctacctgtccccgaacgacctggtgtacgtccccaccgaggaggagctccagctgcgcgagtgcaagctgaacaaggaccggatctacaagatggtgagctccaccgggaacgagtgccacttcatcccctactacgtcgccaacgtgatctacaacaagggcgggttcaacatgcagatgcaccgcccccagagctga

SEQ ID NO: 2223 - RNA, 4374 nt, synthetic construct
  misc_feature 1..4374: note = Cas9 variant
  source 1..4374: mol_type = other RNA
atggccaagatcctgggcctcgacctggggaccaacagcatcggctgggccatcgtggagaagaacaactccgacttcaccctgatcgacaagggggtccgcatcttcagcgagggcgtgaagacggagaaggggatcgagcggtcccgcgcggccgagcggaccggctaccgcagcgcccggaagatcaagtaccgccggaagctccgcaagtacgagaccctgaaggtgctgtccaagaaccggatgtgccccctccagatcgaggacgtcgaggcctggaagaagtccggcttcaaggactacccgctgatccccgagttcctgcagtggctccgcaccaacgaccacgagaacgtgaacccctacttcttccgggacaaggcctcccgcgcgaaggtgagcctgtgggagctggggcgggccttctaccacatcgcccagcgccggggcttcctctccaaccgcctggaccagagctccgagggggtcctggaggagcacaacccccagatccagagcctcatcgaggacctggaggagacgtccaccatcctgaacgaggtgcgggactactacatcaacctcggcctgctggacggggtgaagggcgacttcaagaaggagctcgacgagggcgagaagaagctcaagagcctgtacaacaccctgatcgccatcatcaagaagaacgagaacgacgtccagaagtgcaaggacgagatcatcaagcgcctgaacaagaaggaggacctggggaaggtgaagggcaagatcaaggacatctcccaggcgatgctcgacgggaacttcaagaccctgggccagtacttctacagcctgtacaacaagggcaagatccggaaccagtacacgtcccgcgaggagcactacctccaggagttcatcaccatctgcaaggtgcaggggatcaacggcatcaacgacgaggagatcctgccggagaagaagttcaccgggctggccaaggacctctacaaggccatcttcttccagcggcccctcaagagccagaagggcctgatcgggaagtgctccttcgagaagaacaagagccgctgcgccatcagccaccccgacttcgaggagtaccgcatgtggaactacctgaacaccatcaagttcggcacgcagtccgacaagaagctgcggttcctgacccaggaggagaagctcaagctgatccccaagttctaccgcaagaacgacttcaacttcgaggtcctggccaaggagctcatcgacaagggcgcgaccttcgggttctacaagagctcccggaagaacgagttcctgtactggttcaactacaagccgaccgacacggtgagcgcctgccagttctccgccagcctgaagaacgccatcggcgaggactggcagaccaaggtgttcacctacaagaccctcaactccgagaagaaggaggtcatccgcacggtggactaccgggacctgtggcacctcctgagcgcctccaccagcgacatctacctgtacgagtacgcgaaggagaagctggggctggaggacaagtccgccaagaccttcagcaagatcaagctcaagaaggacttcgcctccctgagcctgtccgccatcaacaagatcctcccctacatcaaggagggcctgctgtacagccacgccgtgttcatggcgaacatcgagaaggtcgtggacgagcacatctggaaggacgtgaaggagcgcaccatcatccagaacgagatctccaagatcatcaagagcgacgtcttcgagcgggaggtgatcaacatcatcaacgggctcatcaagaactccaagacggagggcgagaactacgccgaggagagcaagaacatcttcaagaccgagttcgacaacgccatcgccaagatcttcgagaagaacaacgacatcgagttcaaccagcccttcctggacgacacctacctgaagtacgtggaggagctcaagaagttcgacaaggcccgcagcttcctgcccgtcccgcggctggacgagaaggtgatccagttcctcctgggcaacaacaaggacgggatggtctactgctccgacaagaacaagaccaagaagctgtaccaccccagcgacatcgagatcttcaagaagaagatcatcaaggacgagttcggcaacgagaagatggtgctcgggagccccctgacgaccagcatcaagaaccccatggcgatgcgcgccctgcaccagctccggaaggtgctgaacaccctgatcctcgaggagcagatcgacgagaacacccgcatccacatcgagatggcccgggagctgaacgacgccaacaagcgcaagggcatccaggactaccagaacgagaacaagaagttccgggaggacgcgatcaaggagatcaagaagctgtacttcgaggagtgcaagaaggaggtcgagccgacggaggaggacgtgctccgctaccagctgtggatcgagcaggacaagaaggagatctacgagcaggggaagtccatccggatcagcgacatcatcggctccaaccccgcctacgacatcgagcacaccgtgccccgcagcatctcccagaacaacagcctgatgaacaagaccctctgcacgccccggttcaaccgcgagatcaagaagcagaagatgccgatcgagctgtccaactacgaggagatcctgccccgcatcgagcactggaagaaggaggccgaggacctcacccggcagatcgagagcatctccaagagcatcaagtccgccagcaccaaggaggccaaggacaagaacatccgccggcgccactacctgaccctgaagcgggactacctcaagggcaagtacgaccgcttcatctgggaggagcccaaggtcgggttcaagaactcccagatccccgacaccggcatcatcaccaagtacgcgcaggcctacctcaagagctacttcaagcgggtggagagcgtgaagggcgggatggtcgccgagttccgcaagcagtggggcatccaggagtcctacatcgacgagaacgggttcaagcactacaaggagaaggaccggagcaagcacacgcaccacaccatcgacgccatcaccatcgcctgcatgaccaaggacaagtacgacgtgctggcgcaggcctggacgtccgaggacgagcaggacaagcagaaggccaagaccctgatgagcgaggccaagccgtggaagaccttcaaggaggacatcgagaagatcgaggaggagatcctggtgtcccacttcaccctggacaacgtcaagaagcagagcaagaagatcgtgcgcgtgcggggcaagaagcagtacgtcgccgagatcgagcgcgacgtgaacgggaaggcgatggccaagaaggacgccaacggcaagatcatctacaagctcaacgagaagggggagaagatcccccggctgcagcagggcgacacgatccgcggctccctgcaccaggacagcatctacggggccatcaagaaccccctcaaccaggaggagatcaagtacgtgatccggaaggacctggagtccctgaaggcgaacgacgtcgacaacatcgtggacgagaccgtgaagcagaaggtcaaggaggccatcgagaacaagatcctcctgctgagctccaacgcccagcagaagaacaagctcgtggacgacgtgtggctgaacaaggagaagcaggtccccatcaagaaggtgcgcatctacgccaacagcgtgaagaacccgctggagatcaaggagcagtccctcctgagcaagtcccggaaggagcacaagcagaaggtctacggccagaacgacgagaactacgccatggcgatctacgagctggacgggaagcgcgagttcgagctcatcaacaacttcaacctggccaagctgatcaagcagaaggagggcttctaccccctcaacaaggagaaggaggtgaaggggaagaaggtgctgtaccccatcgccaagagcaactaccgggacgtcgtgctgaagcgcggccagcaggtcgtgttctacgacaaggaggtggagaacccgaaggacatctccgaggtgatcgacttcaagggccggatctacatcatcgaggggctcagcatccagcgcatcgtccgcccctccggcaagatcgacgagtacggggtgatcatgctgaagtacttcaaggaggcccggaaggccgacgagatcaagaaggacaactacaagcccgacggcgtgttcaagctgggggagaaccgccccacccggaagatgaaccacagccagttcaccgcgttcgtcgagggcatcgacttcaaggtgctcccgacgggcaagttcgacaagatctga

SEQ ID NO: 2224 - RNA, 4377 nt, synthetic construct
  misc_feature 1..4377: note = Cas9 variant
  source 1..4377: mol_type = other RNA
atgaccaagaccatcctgggcctcgacctggggacgaacagcatcggctgggccctgatcaaccaggacttcgacaacaagaagggggagatcctcggcatggggtcccgcatcatccccatgacccaggacatcaaggacgagttcggcaagggcaacagcatctcccagaccgccgagcggacccgcctgcgcggggtgcggcggctgatccaccgcacgctcctgcggcgcgagcggctgcaccgcgtcctcaacatcatcggcttcctgccggagcactacgcgaaccagatcgacttcgagaagcggttcgggaagttcaagcccgagagcgagcccaagatctccttcgacggcaacgacgtgttcctgttcgagaagtcctaccaggagatgctcgtggacttcaagatccaccagccccagctggtcagcaacgggaagaagatcccgcacgactggaccatctactacctgcgcaagaaggccctcagcaagaagatcgagaaggaggagctggcctggatcctgctcaacttcaaccagaagcggggctactaccagctgcgcggcgaggaggaggaggagacccccaacaagctggtggagttccactccctcaagatcgtggaggtcaacgccgacgagccccagaaggggaagcccgagatctggtacagcctggtgctggagaacggctgggtgtaccggcgcgcctccaagaccccgctgttcgactggaaggacaagatccgggagttcatcgtcacgaccgagatcaacaacgacgggaccgtgaagaccgacaaggagggcacggagaagcgcagcttccgggcgcccaagcccgaggactggaccctgcagaagaagaagaccgagttcgagctgtccaagagcggcaacgaggtgggggccttcatctacgagtccatcctccagaagcccaaccagaagatccgcggcaagctgatcagcaccatcgagcggaagttctacaaggaggagctgaagacgatcctcaagacccagctgttcttccacaaggagctgaaggacgagaagctctacaacgcctgcatcgaggagctgtacaagaacaacgaggcccaccgctccctgctcagcaacaaggggttcgagcacctgttcatcaacgacatcctgttctaccagcgcccgctccggtccaagaagtcccagatcagcaactgccccctggagaagcgcacctacaagaaggagggcatcgagatcaccgaggggatcaaggtcatcagcaagagcaaccccatctaccaggagttccggctgtggcagtggatctccaacctcagcctgtactgcatcgagcccacggagaccaacgtgacctccaccttcctgaacagcatcgaggactacgagaacctcttcgagttcctgaacaaccgcaaggagatcgagcagaagcacctcctcaagtacctgctggagaaccagggcttcaagggcaagctgctcacgaacgagctggagaagttccggtggaacttcgtggcggacaagaagtacccgtgcaacgagaccgggtccctgctccacacccgcctgagcaaggtcaagaacatctcccccgacttcctgaccaaggagatcgagcaccagctctggcacatcatctacagcgtgacggacaagatcgagtacgagcaggccctgaagaccttcgcccggaagaacaacctggacgtggactccttcttcgagcacttcaagaagatcccgcccttcgagagcacctacggcgcctactccgagaaggccatcaagaagctcctgcccctgatccgcctcgggaagtactggaactgggaggcgatcgacagcatctccaaggaccggatcagcaagatcctgtccggcgagtacgacgagaacatcaagaaccgcgtccgggagaaggccgtgcacctgaccagcgagaacaacttccaggggctccaggagtggctggccaagtacatcgtgtacgaccgccactccgagggcaacgacctgggcaagtggacgagcgtcagcgacctcgagacctacctgaaggagttcaagcagcactccctgcggaaccccatcgtggagcaggtcatcaccgagaccctccgcgtggtgaaggacatctggatcaagcacgggaagggcacggagaacttcttcgacgagatccacgtcgagctggggcgggagatgaagaacaacagcgaggaccgcaagcggctgaccaacaccatcaccgagaacgagaacaccaacctccgcatcaaggccctgctgatggagatgatgaacgacaacgacgtggagaacgtgcggccctactcccccagccagcaggagatcctcaagatctacgaggacggcgccctgaactccaacatcgagctggacgacgagatcgtcaagatcagcaagaaggcggagccgacgaagtccgagctccagcgctacaagctgtggctggagcagaagtaccgcagcccctacaccggccaggtgatccccctcaacaagctgttcacctccgagtacgagatcgagcacgtggtcccccagagccggttcttcgacgactccttcagcaacaaggtgatctgcgagtccgccgtgaacaagcgcaaggacaaccagctggggctccagttcatcaagaaccacagcggcgagaaggtcgagctggggttcggcaaggtggtgcaggtcttcaccgaggagcagtacctggacttcgtgaaggagcactactccaagaaccggagcaagcacaacaagctcctgctggaggagatcccggagaagatgatcgagcgccagctcaacgacacgcggtacatctccaagttcgtgagcagcatcctgtccaacatcgtccgcagcgagaaggacgacgacgggctgaactccaagaacatcctccccggcaacggcaagatcaccaccgagctgaagcgggactgggggctgaacgacgtgtggaacgacctcatcctgccccgcttcgagcggatgaacaccatcacgaacagcgacctgttcaccacctacaacgacaagtaccagaagcacctcccgaccgtgcccttcgagtactccaagggcttccagaagaagcgcatcgaccaccggcaccacgccatggacgccctggtcatcgcctgcgcgacgcgcgaccacctgaacctcatgaacaaccagagcgccaagtccgagctgaagcggtacgacctgcagaacaagctccgcaagaaggagccctacttcaaccagaaggagaacaagcagaaggaggccttcaaggacttcatcaagccctgggggaccttcaccgaggacagcaagaacgccctggagaagatcatcatctccttcaagcagaacctgcgggtgatcaacaaggccaccaacagctacgagtcctacaaggacgaggacggcaacctccgcatcgggaaggacggcaagccggagaagggcctgatcaagcagaaggggctgaactgggcgatccggaagcccctccacaaggacacggtgagcggccagatcaacctgtcccgcatcaagctgcccaacgggaagatcctcaccgccacccggaagaacctggacaccagcttcgacctgaagacgatcgagaactccatcaccgacaccggcatccagaagatcctcaagaactacctgctgagcaaggagtcccccgagctcgccttcagcccggaggggctggaggagatgaacaacgagatcgagaagtacaacaacggcaagttccaccaccccatcaacaaggcccgcatctacgagctgggctccaagttcaacgtcgggcagaccggcaaccggcgcgacaagttcgtggaggcggccaaggggacgaacctcttcttcgccatctaccaggacgagaacaagaaccgcagctacgagaccatccccctgaacgaggtgatcgagcaccagaagtggcgggccagcctgcccaaggaggagcaggagaagatcccgctcgtccccgtgaacaagctgaagggcaccttcatcttctccctgagccccaacgacctcgtgtacgtcccctccaacgacgagctggagcgcagcgcctccatcgacttcagcaagctgaagaaggagcagatcaaccggctctacaagatggtgtccagctccgggagccagtgcttcttcgtgaagtccgaggtcgcgaccagcgtggtgaacaagatggagtactccagcctgaacaagatggagaagtccatcgacaacctgatggtcaaggagatctgcatcaagctcaagatcgaccgcctgggcaacatcagcaaggcctga

SEQ ID NO: 2225 - RNA, 4377 nt, synthetic construct
  misc_feature 1..4377: note = Cas9 variant
  source 1..4377: mol_type = other RNA
atgaagaagatcctgggcctcgacctggggaccaacagcatcggctgggccctgatcgagcaggacttcgagtccaaggccgggaagatcagcggcgcggggtcccgcatcatccccatgagccaggacatcctcggcaccttcgagacgggccagtcctacagccagaccgccgaccggacccactaccgctccatccggcgcctgtaccagcggaccaagctgcgccgggagcgcctccaccggagcctgaacgtgctggggttcctcccggagcactacaagaacgagatcgacttcgagcagcgcaagggccagttctaccccaacaaggagcccaagatcgcctactaccccgagcaggtcgcctccaaggtgaagtaccagttcctgttcaagagctccttcctggagatggtggaggacttcaagcggcgcgggtacaacggcgccatcccgtacgactggacgatctactacctccggaagaaggcgctggagaagaagatcgagaaggaggagctggcctggctcctgctgaacttcaaccagaagcgcgggtactaccagctccggggcgaggaggaggacaccaacagcaacaagaaggaggagttctacgagctgaaggtctccagcgtggagcagacccacgacacctcccccagcggcacgtggtacaacgtgcacctccagaacgggtgggtctaccgccggaagtccaaggacagcctgaaggactgggagggcctgaacaagaagttcatcgtgaccacccacctgaacgccgacgggtccgagaagctcgacaaggacggcaacgtgagccgcagcttccgggcccccaaggaggacgactggggcctggtcaagaagcgcaccgagtccgtgctggagaagtccgggctccacgtgggcgagttcatctacgagagcctgctggagaaccccgagcagaagatccgggggagcctcatcaagacgatcgagcgcaagtactacaagaaggagctggaggcgatcctggacaagcagacctccttccaccgcgagctccggaacgacgccctgtacaaggaggccaccctggagctctacccgaagaacagcgcccaccgctccaacatcaagcagcggggcttcaagtacctgttcatcgaggacatcatcttctaccagcgccccctcaagagccagaagcacctgatcgcccactgccagtacgagaagcggacctacaagaacaacgggggcgagacgatcgaggtctccctgcagggcgcgcccaagagccacccctccttccaggagttccgcatctggcagttcatcagcaacctgcggttctacgacaaggaggagatcgtggaggggcaggaggtgtccatcaccgagaagctcctcaagagcgactccgacttcgccgagctgtaccactggctgagccaccagcgcgaggtcgaccagaacaagaccctgaagtacttcacccagaagaagctgatcccgaagcagaagaaggacaaccccacgatccggtggaacttccccgaggacaagaagtacgagatgggcgagttcaaggcccagctcctgtcccgcctggagaaggtgcggaactgccagcccgacaagttcctgacccagaagaacgagctcgacctgtggcacatcatctacagcgtgaccgacaagaccgagttcgagaaggccctggtcacgttcgccgagaagcgcgagctcgactccgagagcttcgtggagaacttcaagaagttcccgcccttcaagaacgactacgcgagctactccctgaaggccatcaagaagatcctgcccctcatgcggcgcgggaagtactggaaggccgagaacctgggcccccagaccctgcagcggatcgagaagatcgtgaacggggaggccgacgacaagatcagcatccgcgcccggaagctcgcgctgcacctgaacgacaccaagtccttccagggcctcccgaccagcctggcctgctacgtcgcctacaaccgccactccgagaacgaggagaaccagaagtggcagacgcccagcgacatcgacaagtacctgaaggacttcaagcagcactccctccggaaccccatcgtggagcagctgatcaccgaggccctgcgcgtggtccgcgacatctggaagcactacggccaggggcagaaggacttcttcgacgagatccacgtggagctcggccgggagatgaagaaccccgccatcaagcgcaagaagctgagccagaagatccaggagaacgagaacaccaactaccggatcaaggaggtcctgcgcaacctcaaggagaacaacatcgacgcgaagccgtactcccccagccaccaggagatcctgaagatctacgaggagggggtgtaccagtccatcgagaacgtggaggacgagatcgagaagatccggaagaacaacacccccagctccaaggacatcaaccgctaccggctgtggctcgagcagggctacatcagcccctacacgggggaggtcatcccgctgtcccagctgttcagcaaccagtacgagatcgagcacatcatcccccgctcccggttcttcgacgacagcctcgccaacaaggtgatctgcgagagctccgtgaacgccctgaaggacaacaagaccgccctggagttcatcaccaaccacggcaacgagaaggtcgagttcgcgggcaagaccgtggagatcctcagctccgacaagtacacggagcactgcaagcgctacttcaagcggaaccgcaccaagctgaagaacctgctcagctacgacgtgcccgaggggttcatcaaccggcagctgaacgactcccgcttcatcagcaagtacgtccggaacctgctctccaacatcgtgcgcgaggaggaggagcgggaggccatcagcaagcacatcctgaccatcccgggctccatcaccagccagctgaagcaggactgggggctcaacgagaagtggaacgaggtggtcacccaccgcttcgagcggctgaacaacctgacgggcaccaccgacttcggcttctgggacaacaagatcaacgccttccgcatcaccgtgcccaaggagctctccaaggggttcaacaagaagcggatcgaccaccgccaccacacgctggacgccctggtgatcgccgcgtgcaccaaggaccacgtcaactacatcaccagcctcaacaccgagcgcaacaaccactccctggtgagcaagctgcggaacacgaagaaggtgctcatcaacggcaaggagcgccggatcgccaaggcctacaagctgccctggtccagcttccccctggacgccaagcaccagctcgagaccaccgtcatctccttcaagcagaacctgcgcgtgatcaacaagagctccaacaagacctggcagtggcggaacgtgaacggggagcagaagaagaagctgatcccgcagacgaagggcgacagctgggccatccgcaagagcatgcacaaggcgaccgtctccgccaaggtggagagcgtggggaagggcaagatcaagaccaccaaccggacgcccctcggcgagatcaagggggagaagcacgtcgagaagatctacgacgcccgcatccgggaggtgatcatccccaaccacctgaacaagtacctggacgagaagggcaagcccaactacgaggccgccttctcccagagcgggatcaagcagctcaacgagaacatcgaggtgctgaacgagggcaagccgcacgcgcccatctacaaggtccccctgttcgaggtggggtccaagttccccgtgagcgaggacgccaagtccccgaagaaccagaagtacgtcgaggccgacaagggcaccaacctcttcttcgccgtgtactggaacgaggagaagcagaagcgcaacttcgagaccgtgcccctgcaccaggtcatcgtgcaccagaagcaggtcgcgagcctgcccaccgagcagcggacgtccgtgcccatcaagccggagctcggcctgttcctgttcagcctctcccccaacgacctggtgtacgtgcccaccgaggaggagatcgagaacccccacctggtcgacctcaagaacctgagcaaggaccagaccaaccgcatctacaagatggtgtccagcaccgggaacgagtgccacttcatcccgcaccacatctcccggctgatcatgaagtacaacgccaagcagaaggtgggcgagttcgggagcctcaacaaggccgagaaggccatcacgggcgagaccatcaaggagaagtgcctgaagatccagatcaactccctggggaagctcaagaccgagcgcatcgcctga

SEQ ID NO: 2226 - RNA, 4380 nt, synthetic construct
  misc_feature 1..4380: note = Cas9 variant
  source 1..4380: mol_type = other RNA
atgaagttcaacctgggcctcgacatcgggaccaacagcatcggctgggccctggtgaacgaggactacgagaacaagaaggggaagatcatcgccgcgggctcccgcatcatccccatgacccaggacatcctggacaagttcgggagcggcgccatcacggagacccagaccgccctccggaccgactaccgctccaagcggaagctgatccagcgcttcctgctccggcgcgagcggctgcaccgcgtcctgaacgtgctcgacttcctgccgaagcactacgccgagagcatcgacttcgagaagtacttcggcaagttcctgcccaacacggagcccaagctcgcctacaaccagaaccagttcatcttccagaactccttcctggagatgctgaaggagttccaggagaagcaccccgagctcctgaccaacaacaagaagatcccgtacgactggaccatctactacctgcggaagaaggcgctcaaccagcgcatcgagaaggaggagctggcctggctgctcctgcagttcaaccagaagcgggggtacaaccagctgcgcgacgaggaggaggagagcgtgcccaacaagcaggtcgagttctactccctcaagatcatcgacgtggtggccgaccagcccaaggagggccgggacaagcgctggtacagcatcaacctggagaacgggtggacctaccggcgcgagtccaagacgcccctgttcaactgggagggcaagaccaaggacttcatcgtcaccaccgacctcaaccaggacgggagcatcaagaaggacaaggagggcaaggagaagcggtccttccgcgccccgagcgagggcgactggacgctgctgaagaagaagaccgagaaggagatctacgagtccgggaagaccctcggcacctacatctacgacgcgctgctgaacacgcccgacctcaagatcaagggggacttcatccggaccatcgaccgcagcatctacaaggaggagctgcagcagatcatcaacaagcagaaggagtaccacctggagctcaactccagcaagctgtacaaggcctgcctggaggagctctaccccaagaacgagatctacaagtccgccctgaagaacaaggacatcgcctacctgttcatcaacgacatcctctactaccagcggcccctgaaggccccgaagtacaacatcggcaagtgcacctacgagagccgcaccttcaagaaggaggacaagaagatccgcgagtacatccccgcggtggccaagtcccaccccctgttccaggagttccggctctggcagtggatcaagaacctgaagatctacgagaagctgagcagcgacaactgcacggacttcttcctcaccaacgagcaggacttcgagaacctgttcgagttcctgtggaacaagaaggagatcgaccacaagggcatcctggagtacctcgtgaagaccaagttccccgacctgaagccgaagcaggtcaagaccaaggtgaaggagtaccgctggaactacgtgtacgaccacgagaaggacgagtccaagacgtacccctgcggggagacctacttcctgctcaagaacaagctggacaagatctacaacgcccaggacgacttcctggacaaggagcggctctacaacctgtggcacatcatctacagcgtcaccgacaagaagcagtacgagaaggccctggccaagttcgcgctcaagaaccacctggacaccaagtccttcgtgaacacgttcaagcgcatcccgcccttcaagaacgactacgccatctacagcctgaaggccatcaagaagctcctgcccctgatgcgggtgggcaagtactggaactacgacgacatcgaccccatcaccaagcagaagatccagtgcatcatcaccggggaggagaacgacaccatctccacgctcgtccgcgagaagaccaaccacttcagcaacgagaacgacttcaagaacctgcccctgtggctcgccggctacatcgtgtacaactcccacaacgagagctccgagatcgagaagtggaagtccccgcaggacatcgacaccttcctgaagaagttcaagcagcacgccctgcggaaccccatcgtggagcaggtcgtgaccgagacgctccgcgtggtccgggacatctggagcaagaaggggcagggcaagaaggacttcttcaacgagatccacatcgagctgggcaaggacctgaagaaccccgtggacaagcgccggaagctcagctccaccaacaccaagaacgagagcaccaacacccgcatcaaggcgctgctgatcgagctgttcacgcagggggtggagaacgtcaagcccaactcccccaagcaccaggagatcctcaagatcttcgaggagggcgccctgaacagcgggatcgagatcgaggaggacatcatcaagatctccaacaccgaccagccgaccaagaagcagctcgagctgtacatcctgtggctcgagcacaagtacaagagcccctacaccggccagtccatccccctgagcaagctgttcacgccgaactacgagatcgagcacatcatcccccggagcaagtactacgacgacaacctctccaacaaggtgatctgcgagaccgagatcaaccgcctgaagaacaaccagctggggtacgagttcatcaacaaccacgagatccgggaggtcaccctcgaggagggcaagaccatccgcctgctgagccccgagcagtactggaacttcgtgacgacctactacgccaagaacaaggccaagcgggagaacctcctgctgaaggagctccccgtgcagatggtcgagaagcagctgaacgacacccgctacgtgtccaagtacgtgatgcagctgctcagcaagatcgtccggaaggaggacggcaccgacaacgggatcaactccacgaacatcctgagcatctccggcaagatgacccgcgccctgaagaacgactgggacctcaacgacgtgtggaacgacctgctgctctaccgcttcgagcggctgaacaccatcaccaagacgaacctgttcaccacctacagcgagcagaagcagaagcgcatgccgatcgtgcccgaccagtacgcgaaggggttccacaagaagcggctcgaccaccgccaccacgccctggacgccatcgtcatcgcctgcatcacccggaaccacatcaactacatgaacaaccagaacatccagggcgagaagctgaagaagaacgcgatcgagaaggagaactaccgcgagatcctccagaagtcccggctggacatccgcgcccagctgtgcgagaagaagtacaacgacaacgaccccacgaagtacaactgggtgttcatcaagccctgggccgacttcaccgagaacaccaaggacatcctcgagagcatcatcccgtccttcaagcagaacctgcggatcatcaacaagaccgtgaactactacgagaagtacaacgagaacgggaagaaggtcaaggtgcgccagatcaagggcgacaactgggccatccggaagcccctgcacaaggagacgatcagcggcaaggtgcacctctcctacaagacccccgccaaggggaagatcctgaccgcgacccgcaaggtcctggacagctccatggacttcaagagcatcgagaagatcacggacaccggcatccagaagatcctcaagaactacctggagtacaagaagtcccccgagctggccttcagcccggaggggatcgaggagctcaacgccaccatcaccaagtacaacaacggcttccaccacaagcccatctacaaggtgcggatctacgaggagggcgtgaagttccccctggggaacaagggcaacaagaagtccaagtacgtcgaggccgagaaggggacgaacctgttcttcgccatctacaaggaccaggagaacaaccgctacttcgagaccatccccttcaacgacgtgctcgagaccctgaagaagggcatgagcgcggtgccggagaagaaccaggaggagaacaccctggtcttcgccctcagcccccaggacctggtgttcgtgcccacgctggacgagatcgagaaccccgacatcgtcgacttcaagaacctcaccaaggaccagaccaaccggatctacaagatggtgtccagctccgggaagcagtgcttcttcatcaaggccgaggtggccaccagcatcgtcaacaagatggagttctccaccagcaacaagatggagaactccatcgagggcatccagatcaagagcaactgctggaagctgaagctggaccgcctcggcacgatcacccgggtgatcaagtga

SEQ ID NO: 2227 - RNA, 4383 nt, synthetic construct
  misc_feature 1..4383: note = Cas9 variant
  source 1..4383: mol_type = other RNA
atgaccaagttcaacctgggcctcgacatcgggaccaacagcatcggctgggccctggtgaacgaggactgcgagaacaagaaggggaagatcctggccgcgggctcccgcatcatccccatgacgcaggacatcctcgacaagttcgggagcggcgccgccaccgagacccagaccgccctgcggacggactaccgctccaagcggaagctgatccagcgcttcctcctgcggcgcgagcggctgcaccgcgtcctcaacgtgctggacttcctgccgaagcactacgccgagagcatcgacttcgagaagtacctcggcaagttcctgcccaacaccgagcccaagctggtgtacaaccagaaccagttcatcttccagaactccttcttcgagatgctcaaggagttccaggagaagcaccccgagctgttcctgaacaaccagaagatcccgtacgactggaccatctactacctccggaagaaggcgctgagccagaagatcgagaaggaggagctggcctggctcctgctgcagttcaaccagaagcgcgggtacaaccagctccgggacgaggaggaggagaacacccccgacaagctggtcgagttctactccctgaagatcatcaaggtgacggccgacgaggccaaggagggcatcaacaagcgctggtacagcatcaacctcgagaacgggtggatctaccggcgcgagtccaagacgcccctgttcaactgggagggcaagaccaagaacttcatcgtgaccaccgacctgaaccaggacgggagcatcaagaaggacaaggagggcaaggagaagcggtccttccgcgcgcccagcgagggcgactggaccctcctgaagaagaagaccgagaaggagatctacgagtccgggaagaccctgggcacgtacatctacgacgccctcctgaacaacccggacctgaagatcaagggggccctcatcaagaccatcgaccggagcatctacaaggaggagctgcagcagatcatcaacaagcagaaggagtaccactccgagctgaacaacagcaagctctacaaggcctgcctggaggagctgtaccccaagaacgagatctacaagaacgagctcaagaacaaggacatcgcctacctgttcatcaacgacatcctgtactaccagcgccccctcaaggcgcccaagtacaacatcggcaagtgctcctacgagagccggaccttcaagaaggaggacaagaagatcaccgagttcatcccggccgtcgccaagtcccaccccctgttccaggagttccgcctgtggcagtggatcaagaacctcaagatctacgagaagctgacgaacgacaactacaccgacttcttcctgaccaacgagcgggacatcgagaagctgttcgacttcctctggaacaagaaggagatcgaccacaagggcatcctggagtacctgatcaagaccaagttccccgacctcaagcccaagcaggtcaagagcaaggtgaaggagtaccgctggaactacatctacgaccacgagaaggacgagagcaagaactacccgtgcggggagacgtacttcctgctgaagaacaagctcgacaagatcacctccatccaggacgacttcctgaacaagaagcgcctggagaacctctggcacatcatctacagcgtgaccgacaagaagcagtacgagaaggccctggccaagttcgcgctgaagaaccagctcgacaccaagtccttcgtgaacacgttcaagcggatccccgccttcaagaacgactacgccatctacagcctgaaggccatcaagaagctgctccccctgatgcgcgtgggcaagtactggaactacgacgacatcgaccccatcaccaagcagaagatccagtgcatcatcaccggggaggagaacgacaccatctccacgctggtccgggagaagaccaaccacttcagcaacgagaacgacttcaagaacctctccctgtggctggccggctacatcgtgtacaacagccacaacgagtccagcgagatcgagaagtggaagtccccgcaggacatcgacaccttcctcaagaagttcaagcagcacgcgctgcgcaaccccatcgtggagcaggtcgtgaccgagacgctgcgggtggtccgcgacatctggctcaagaaggggcagggcaagaaggacttcttcaacgagatccacatcgagctgggcaaggacctgaagaaccccgtggacaagcggcgcaagatcagctccaccaacagcaagaacgagaccaccaacatccggatcaaggccctcctgaaggagctgctcaaggaggggatcgagaacatcaagcccaactccccgaagcagcaggagatcctgaagatcttcgaggagggcatcctgaacagcgggatcgacatcgaggaggagatcatcaagatctcccagatcgcccagcccaccaagaagcagctccagtactaccgcaactggctggagcagaagtacatcagcccctacacgggccagttcatccccctgtccaagctgttcaccagcaagtacgagatcgagcacatcatcccgcggagcaagtactacgacgactccctcagcaacaaggtgatctgcgagaccgagatcaaccgcctgaagaacaaccagctcgggtacgagttcatcaacaaccacgagatccgggagatcaccctggaggagggcaagacgatccgcctgctctcccccaagcagtacctggacttcgtcaccacctactacggcaagaacaaggccaagcgggagaacctgctcctgaaggagatccccatccagatgatcgagaaccagctgaacgacacccgctacgtgagcaagtacgtgatgcagctcctgtccaagatcgtccggaaggaggacgggacggacaacggcaccaacagcatcaacatcctgtccgtgagcgggaagatcacccgcgtcctcaagaccgactggggcctgaacgacgtgtggaacgacctgctctgctaccggttcgagcgcctgaacaagatcacgaacaccaacctgttcaccacctactccgagcagaagcagaagatcatcccgatcgtgcccgaccagtacgccaaggggttccacaagaagaagctcgaccaccgccaccacgcgctggacgccatcctgatcgcctgcatcacgcggaaccacatcaactacatgaacaaccagaacatccagggcgagaagctcaagaacttcaagatcgacaagcacaactaccacgagatcttccagaagtcccgcctggacatgcgggcccagctgtgcgagaagaagtacaacgaccacgacagcaccaagtacacctgggtcttcaccaagccctgggcggacttcacggagaacatcaaggacaccctcgagttcatcatccccagcttcaagcagaacctgcgcatcatcaacaagaccgtgaactactacgagaagtacaacgagaacggcaagaaggtgaaggtccggcagaccaagggggacaactgggccatccgcaagccgctgcacaaggagacgatctccggcaaggtgcacctcctgtacaagacccccgccaaggggaagatcctgaccgccacccggaaggtgctcgacagctccatggacttcaagagcatcgagaagatcacggacaccggcatccagaagatcctgaagaactacctgaagtacaaggagtcccccgagctcgccttcagccccgagggcatcgaggagctgaacatcaccatcgcgaagtacaacgacgggttctaccacaagccgatctacaaggtccgcatctacgaggagggcgtgaagttccccctggggaaccggggcaacaagaagaacaagtacgtggaggccgagaaggggaccaacctcttcttcgccatctacaaggaccaggagaacaaccgctacttcgagacgatccccttcaacgacgtcctggagaccctgaagaagggcatgagcgccgtgcccgagaagaaccaggagaagaacaccctcgtgttcgccctgtccccgcaggacctggtcttcgtgcccaccctcgacgagatcgagaaccccgacatcgtggacttccggaacctgacgaaggaccagaccaaccgcatctacaagatggtcagctccagcggcaagcagtgcttcttcatcaaggcggaggtggccacctccatcgtgaacaagatggagttcaccaccagcaacaagatggagaactccatcgaggggatccagatcaagagcaactgctggaagctgaagctcgaccggctgggcacgatcacccgcgtcatcaagtga

SEQ ID NO: 2228 - RNA, 4389 nt, synthetic construct
  misc_feature 1..4389: note = Cas9 variant
  source 1..4389: mol_type = other RNA
atgaccaagaacatcctgggcctcgacctggggaccaacagcatcggctgggccctgatcaagcagaacttcgagaacaagcagggggagatcctcggcatggggtcccgcatcatccccatgagccaggacatcctgggcgacttcggcaaggggaactccgtgagccagacggccgagcggaccaagtaccgctccgtccggcgcctgcgggagcgcttcctcctgcggcgcgagcggctgcaccgcgtgctcaacctgctgaacttcctcccgcagcactacgcgagccagatcgacttcgagaagcggttcggcaagttcaaggtggagaccgagcccaagctggcctggaagaacatcgacgggcagttctccttcctgttccagaccagcttcaacgagatgctcgaggacttccgcgtcaacggccaggacgtgaagatcccctacgactggacgatctactacctgcggaagaaggccctgtccaagaagatcgagaaggaggagctcgcctggatcctgctgaacttcaaccagaagcgcgggtactaccagctccggggcgaggaggaggaggagaaccccaacaagctggtggagttctacagcctgaaggtcgtggacgtggtcgccgacgagccgcagaagggcaagttcgacatctggtactccctcatcctggagaacgggtgggtgtaccgccggagctccaagatccccctgttcgactggaaggacaagacccgcgacttcatcgtgaccaccgacctcaacgacgacggcagcatcaagaaggacaaggacgggaacgagaagcggtccttccgcgcgcccagcgagaacgactggacgctggtcaagaagaagaccgagcaggagatcgagcagtcccggaagaccgtgggcacctacatctacgaggccctgctcgacaaccccaagcagaagatcaagggcaagctggtgcgcacgatcgagcgcaagttctacaaggaggagctgcggcagatcctcgagaagcagaaggagttccaccaggagctgcagagcgacgacctgtacaacgactgcgtccgcgagctctaccggaacaacgaggcccaccagctgaccctgtccaagaaggacttcgtgcacctcctgatggacgacctgatcttctaccagcgcccgctccggagccagaagtccagcgtgagcaactgcaccctggagttccgcaagtacaaggacgagaacggggccgagcacacccagtacctgaaggcgatccccaagtccaacccctactaccaggagttccggctctggcagtggatctacaacctgaacatctaccgccgggaggacgagcagaaccccatcacgggcgagttcctgagcaccaccaaggagttcgagaacctcttcgagttcctgaacacccgcaaggaggtcgaccagaaggccctgctgaagcacttcaagctcaacgacaagacgcaccggtggaacttcgtggaggacaagaagtacccgtgcaacgagaccaagaccatgatctccagccgcctggagaaggtggagaacatctccgacgacttcctgacccgggagatcgagcagaagatctggcacatcatctacagcgtcaacgacaagatcgagtacgagaaggccctcaagtccttcgccaagaagcaccacctggacgagagctccttcttcgaggccttccgcaagttcccgcccttcaagagcgagtacgggtccttcagcgagaaggcggtgaagaagctgctccccctgatgcggctgggcaagtactggaactacgccgacatcgacaagtccagcaaggagcgcatccagaagatcatctccggggagtacgacgagaacatcaaggaccgggtgcgcgagaagtccgtccacctcacgaccgagaacgacttccagggcctgcagctgtggctcgcccagtacatcgtgtacggccggcacagcgaggccagcatgatcgggaagtggaacagcgccgacgacctggaggagttcctgaagaacttcaagcagcactccctccgcaaccccatcgtcgagcaggtcatcaccgagaccctgcgcgtggtgaaggacatctggctgaagtacggcaacggggcgaaggacttcttcaacgagatccacatcgagctcggccgggagatgaagctgcccgccaaggagcgcgaggacctgacgcggaagatcaccgagaacgagaacaccaacctccgcatcaaggccctgctggccgagatgatgaacgacagctccgtggagaacgtgcggcccttcagccccatgcagcaggagatcctcaagatctacgaggacggggtcctgaactccggcatcgagatcgaggacgagtacctgaagatcagcaagaccgcccagccgtcccccagcgacctcaagcgctacaagctgtggctggagcagaagtacaagtccccctacacgggccagatcatccccctcaacaagctgttcaccccggagtacgagatcgagcacatcatcccccagagccggtacttcgacgactccttcagcaacaagatcatctgcgagtccgcggtgaacaagctgaaggacaactacatcgggctcggcttcatcaagcagttcgggggcaccatcatcgagctggggttcggcaagagcgtgaaggtcttcgagaccgaggagtacgaggacttcgtgaagaagcactacgccaacaaccgctccaagcggaacaagctgctcctggaggacatccccgagaagatgatcgagcgccagatcaacgacacgcggcacatcagcaagtacatctccggcgtgctgagcaacatcgtccgcatcgacgacgaccaggccaagaagatcatcgaggacgccgagatcctcgcccggaaggagatcgacaaggacaaggcgaacgagatccgccggaaggccaagagcctggccaccgacgacgggatcaactccaagaacatcgtgcccggcaacgggaagatcaccacccagctgaagcaggactggggcctcaacgacgtgtggaacgacctgatcctgccgcgcttcgagcggatgaaccagctcaccaacagcaaggacttcacggtctggaacgagaaccaccagaagtacctgcccaccgtgcccatcgagttctccaagggcttcagcaagaagcgcatcgaccaccggcaccacgccctggacgcgctcgtgatcgcctgcgccaccaaggaccacgtcaacctgctgaacaaccagtccgccaagagcgacaccaagcgctacgacctcaagaagaagctgatgaagttcgagaaggtggtgtaccaccacacgcagaccgggaacaagatcgagcgggagatcccgaagcagttcctgaagccctgggagaacttcaccttcgacgccaagtacaacctcgagtccatcatcgtcagcttcaagcagaacctgcgcgtgatcaacaaggcgaccaactactacgagaagtacgtggagaaggacggcacgaagaacaaggggcgcgtcgagcagaccggcaccaactgggccatccggaagcccatgcacaaggacaccgtgtccgggaaggtgaacctgccctgggtcaaggtgccgaagggcaagatcctcacggccacccgcaagatcctggacaccagcttcgacctgaagtccatcggcagcatcaccgacacggggatccagaagatcctccggaactacctggagttcaagggctcccccgagctggccttcagccccgaggggatcgaggacctcaacaagaacatcgagaagtacaacgacggcaagccccaccagccgatcaacaaggtgcgcgtcttcgagctggggtccaagttccaggtgggccagaccggcaacaagaaggacaagtacgtggaggccgcgaaggggaccaacctgttcttcgccgtctacgaggacaagaacggcaagcggagctacgagaccatccccctcaacgaggtgatcgagcgccagaagcaggggctgtccgtggtcgacctgaagggcacgaacgacttctacctctgccccaacgacctggtgtacatccccagcgacgacgagctggagaacatcaacaacatcgacttcaagaacatcgccaaggagaagaacgagcggatctacaaggtggtctccttcagcgggagccagatcttcttcgtgcgccaggacatcgccacctccatcgtgaacaaggccgagctcagcaccctgaacaagatggagcgggcgatggacggctccatgatcaaggagagctgcgtcaagctgaacgtggaccgcctcggcaacatctccaaggcctga

SEQ ID NO: 2229 - RNA, 4401 nt, synthetic construct
  misc_feature 1..4401: note = Cas9 variant
  source 1..4401: mol_type = other RNA
atgaccaagaacatcctgggcctcgacctggggaccaacagcatcggctgggccctgatcaagcaggacttcgagaacaagcagggggagatcctcggcatggggtcccgcatcatccccatgagccaggacgtgctgggcgagttcggcaaggggaactccgtcagccagacggccgcgcggaccgactaccgcggcgtgcggcgcctgcggaagcgcttcctcctgcggcgcgagcggctgcaccgcgtgctcaacgtcctgaacttcctgccggtgcactacgcctcccagatcgacttcgagaagcggttcgggaagttcaaggaggacaccgagcccaagctcgcctacaacaaggagggcttcatcttcaagaacagcttcgaggagatggtggccgacttccgcaagcaccagccccagctgctggagaacgacaagaagatcccctacgactggaccatctactacctccggaagaaggccctgtccaagaagatcgagaaggaggagctggcgtggatcctcctgaacttcaaccagaagcgcgggtactaccagctgcggggcgaggaggaggaggagaacccgaacaagctcgtcgagttctacagcctgaagatcacggacgtgctggccgacgagccccagaagggcaagtccgacatctggtacagcctcatcctggagaacgggtggatctaccgccggtccagcaagacgcccctgttcgactggaaggagaagacccgcgacttcatcgtgaccaccgacctcaacgacgacggctccatcaagaccgacaaggacgggaacgagaagcggagcttccgcgccccctccgagaacgactggaccctggtcaagaagaagaccgagcaggagatcgacaagagccagaagacggtgggcacctacatctacgagaccctgctccagaacccgaagcagaagatcaagggcaagctggtgtgcaccatcgagcggaagttctacaaggaggagctgaagcagatcctcgagaagcagaaggagttccaccaggagctgcagaacgacgacctgtactccgactgcgtccacgagctctaccgcacgaacgaggcccaccagctgaccctgagcaagaaggagatcgtgaacctcttcatggaggacctgatcttctaccagcgccccctgcggtcccagaagaccagcatcagcaactgcaccctcgagttccgcaagtacaaggacgagaacggggtggagcacacgcagttcctgaaggcgatccccaagtccaacccctactaccaggagttccggatctggcagtggatcttcaacctgaacatctacaagcgcgacgacgacagcaacgtcaccaaggagttcctcaacaccaccgaggacttcgagaacctgttcgagttcctgaacaaccggaaggaggtggagcagaaggccctcctgaagcacttcaagctgaacgagaagctgcaccgctggaacttcgtggaggacaagaagtacccgtgcaacgagacgaagaccatgatctccacccggctcgacaaggtcgagaacatcagcaaggacttcttcacccgcgagatcgagcagaagatctggcacatcatctactccgtgaacgacaagatcgagtacgagaaggccctgaagtccttcgccatcaagcacaacctggacgagaactccttcttcgaggccttcaagaagttcccgcccttcaagagcgagtacggctccttcagcgagaaggcgatcaagaagctcctgcccctgatgcggctcgggaagtactggaacgaggacgagatcctgaagtactccgacgactacttcaagaacatcgagagcctgctcggcgtgctgaagcagcgcgacgagaacatctccgacgccgaccgggagaactacaacaagacgatcaacaacaagctgcgcgccgagctcgagaacttccagaacgccgagatcgagagcttccaggggctgcggctgcacatcgcccagtacatcctctacggcaagcactccgagggcgacaacaagaagttcaacagcgcggacgacctggagaagttcctgaaggagttcaagcagcactccctccgcaaccccatcgtcgagcaggtcatcaccgagaccctgcgggtggtgaaggacatctggaccaagtacgggaacggcgccaaggacttcttcgacgagatccacatcgagctggggcgcgacatgaagaagacgcgggacgagcgcgccgacgccaccaagatcatcaccgagaacgagaacaccaacctccggatcaaggccctgctggcggagatgatgaacgacgtggagatggagaacgtccgcccctacagccccatgcagcaggagatcctcaagatctacgaggacggcatcctgaagtccgacatcgagatcgaggacgacatcctgaagatcagcaagacggcccagcccagctccagcgacctcaagcgctacaagctgtggctggagcagaagtacaagtccccgtacaccgggcagatcatccccctcaacaagctgttcacccccgagtacgagatcgagcacatcatcccccagagccggtacttcgacgactccttcagcaacaagatcatctgcgagtccgccgtgaacaagctgaaggacaactacatcggcctcggcttcatcaagcagttcgggggcaccatcgtggagtgcgggttcggcaagaacgtcaaggtgttcgaggccgaggagtacgaggacttcgtgaagaagcactacgccaacaaccgcgggaagcggaacaagctgctgctcgaggagatcccggagaagatgatcgagcgccagatgaacgacacccggcacatcagcaagtacatctccggcgtcctgagcaacatcgtgcgcgtggaggacggctccgacgagggggtcaacagcaagaacatcgtgcccggcaacgggaagatcacgacccagctgaagcaggactggggcctcaacgacgtgtggaacgagctgatcctgccccggttcgagcgcatgaaccagctcaccaactccaccgacttcacggcgtggaacgagaaccaccagaagttcctgcccaccgtcccgatcgagttcagcaagggcttctccaagaagcggatcgaccaccgccaccacgccctggacgccctcatcatcgcctgcgcgaccaaggaccacgtgaacctgctgaacaaccagagcgccaagtccgacaccaagcggtacgacctcaagaagaagctgatgaagttcgagaaggtggtctacaaccacccccagacgggggaccgcatcgagcgggaggtgcccaagcagttcctgaagccgtgggacaacttcaccttcgaggccaagaacaacctcgacaagatcatcgtgagcttcaagcagaacctgcgcgtcatcaacaaggccaccaactactacgagaagttcgtggagaaggacggcgtgaagaccaaggagcgggtcgagcagaaggggacgaactgggccatccgcaagagcctgcacgaggagaccgtgtccggcaagatcgacctcccctgggtggagaccaacaacggggagttcatcaccgcgacgcgcaagagcctggacgcctccttcaacctggagaagatcaagaagatcaccgacaccggcatccagaagatcctccggaactacctgaaggccaaggacgacaacgccgagctggccttcagccccgagggcatcgaggacctcaacaagaacatcgagaagtacaacgacgggaagtcccaccagcccatcgtccgggtgcgcgtgtacgagaagggcaaggggcggttcgcgctgggccagaccgggaacaacatcgacaagtacgtccagggcagcccgaacctgttcttcgccatctacaaggacgagaacggcaagaagtcctacgagagcatccgcctcgacatcgtgatcgagcgcatgaagcaggggctgcaggccgtgcccgagacgaaccccaacggcatctccctgtaccagaacctcagccccctggacctggtctacatcccgaccgaggacgagatcgagagcccccacctcatcgacttcaccatcctgaacaagacccggctggagcgcatctacaacgtgaacgacttcagcgggtacacgatctacttctcccagaacagcttcgccaagaacatctaccccaaggagatggacatgacctggaacgagaagaagcagaagccctccggcagcttcgactccaagaccgccagctacaacaagaagtccatcaaggacatcttcatcaagctcaagatcgaccggctggggaacatcagcaaggtgagcaacaccctgtga

SEQ ID NO: 2230 - RNA, 4401 nt, synthetic construct
  misc_feature 1..4401: note = Cas9 variant
  source 1..4401: mol_type = other RNA
atgaagaacatcctgggcctcgacctggggaccaacagcatcggctgggccctggtgaaggaggacttcgagaacaagcagggggagatcctcggcctggggtcccgcatcatccccatgagccaggacatcctgggcgagttcggccgggggaactccatcagccagaccgccgaccgcaccggctaccgcggggtccggcggctccgcgagcggcacctcctgcgccgggagcgcctccaccgggtgctgaacatcctgggcttcctcccgaaccactacgcgaaggagatcgacttcaccaagcgcctggggaagttcatcaaccacgccgagcccaagctgtccttcgacaaggagttcatcttcaaggacagcttcaacgagatgctcaaggacttccagcagaaccagcccggcttcatcatcaacaagcacggcgaggaggccctggtgccctacgactggaccatctactacctgcggaagaaggccctcacccagaagatcgacaaggaggagctggcctggatcctgctcaacttcaaccagaagcgcgggtactaccagctgcggggcgaggaggaggaggagaacacgaacaagctggtcgagttctactccctcaagatcatcgacgtgatcgcggacaacgaggtgaacaagaagggggaggtctggtacagcctgcacctggagaacggctggatctaccgccggtccagcaagatctccctcgtggactggaaggacaaggtgcgcgacttcatcgtcaccaccgacgtgaacgacgacggcagcgagaagctggacaaggacggggtggtcaagcggtccttccgcgccccgagcgccgacgactggaccctgctcaagaagaagacggagcaggacatcgacaactccaacaagaccgtgggcgcctacatctacgagaacctgctgctcaaccccaagcagaagatcaaggggaagctggtgcggaccatcgagcgcaagttctacaaggacgagctgaagcagatcctcgagaagcagaaggagttccaccaggagctgcagaacgagcagctgctccaggactgcgtccgcgagctgtacaagtacaacgagcagcaccagcagatgctggagagcaaggacttcgtgcacctcttcctgaacgacatcatcttctaccagcggcccctgcgctcccagaagtccctcatctccaactgcaccctggagaagcgggtgagccgcgacggcgtcgtgttccccatcaaggtgatcagcaagtccaacccgtactaccaggagttccggctgctccagtggctgcagaacctggcgatctaccgcaaggacgacgacgtcaacgtgacgcaggagttcctgaacagcatcgagtcctgggagaacctcctgcagttcctgaacgccaagaaggagatcaagcaggagcagctcatcaagttcctgctggagcagaaggggctcaagggcaacagcctgaagaccgccatcctgacctaccggtggaactacgtgaccgacaaggtctaccccatgaacgagacgcgctccctcatccaggacaagctgaagaaggtggagaacgtcgccaccgacttcctgagcttcgacaacgagatggccctctggcacatcatctactccgtgaacgacaagatcgagtacgagaaggcgctggccaagttcgccagcaagcacaacctggacgagatctccttcgtggagagcttcaagaagttcccgcccttcaagtccgactacggcagcttctccgagaaggccatcaagaagctcctgcccctgatgcggttcgggagcgtctggaacaagaacaacatcgtgccctccgtgctcgaccgcatcgacaagatcctgaccggcgagtacgacgagaagatcaagatccgggtccgcgagaaggccgagcagttccagctgaaccagatcgaggacttccagaacctccccctgtggctggcgcagtacgtggtgtacgaccggcacagcgaggccgagatcgccgggaagtggaactccgtcaaggacctcgagaactacctgaaggagttcaagcagcacagcctgcgcaaccccatcgtggagcagatcatcaccgagacgctccgggtggtcaaggacatctggcagcagtacggcaacggggtgcagaacttcttcgacgagatccacatcgagctgggccgcgagatgaagaacaccgccgacgagcggaagcgcatcaccaactccgtgaccgagaacgagaacacgaacctgcggatcaaggccctcctggtcgagctgaaggaggacaccaacatcgagaacgtgcgcccgcacagccccatgcagcaggagatcctcaagatctacgaggagggcgtgctgaacgcggtcgagaacatcgacgaggacatcctgaagatcagcaagaccgcccagccctccaagagcgagctcatccgctacaagctgtggctggagcagaagtaccagtccccctacaccggggagatgatcccgctcagccggctgttcacgtccgactacgagatcgagcacgtgatcccccagagccgctacttcgacgactccctgagcaacaaggtgatctgcgaggccgccgtcaacaagcggaaggacaaccagctcggcctggagttcatcaagaaccaccactccgagaagatcgagctggggaacggccgcaccgcccaggtgctcgaggtggaggcgtacgagagcttcgtcaagaagaactacgacaagaaccgggggaagcgcaacaagctgctgctcgaggacgtgcccgagaagatgatcgagcggcagctgaacgacacccgctacatctccaagttcgtgacccacctcctgagcaacatcgtccggaaggacgaggtgaactccaaggacgacggcatcaacagcaagaacatcatccccggcaacgggaagatcacgtcccagctgaagcaggactggggcctgaacgacgtgtggaacgagctcatcctgccgcgcttcgagcggatgaacaacctgaccaacagcaccgacttcacctccacgaacaccaacgggaagatcatccccaccgtccccctcgagtacagcaagggcttcagcaagaagcgcatcgaccaccggcaccacgccctggacgccctggtgatcgccctcgcgacccgcgaccacgtgaacctgctgaacaacgagtccgccctccccaagaaggaccggaccaaggaggagcagaagtccttccgcttcgacctgcaggtcaacctgcggaacaaggagaagtacttcaacgtgaaggagggccgcgagaaggagaagttcacgaccttcaagaagccgtggaacaccctcacccaggacacgcgggacgccctggagaacatggtggtcagcttcaagcagaacctgcgcgtgatcaacaaggccaccaactactacgagagctacaccgacgagaacgggaacctccggctggacaagtacggcaaccccaagaaggagctgatctcccagaaggggaccaactgggccatccgcaagagcctccacaaggagacggtgtccggccagatccacctggaccgcgtcaaggtgaccaaggggaagatcgtgaccgcgacccgcaagagcctggactccagcttcaacgagaagtccatcgagagcatcacggacaccggcatccagaagatcctccggaactacctgaaggccaaggacaacaagcccgacgtcgccttctccccggagggcatcgaggagctgaacaagagcatctccgtgtacaacgaggggaagaaccaccagcccatcatcaaggtgcggatcttcgagcagggcagcaagttccccgtcggggagaccggcaacaagatcgccaagttcgtggaggccgcgaaggggaccaacctcttcttcggcatctaccaggacaagacgggcaagcgctcctacgacaccatccccctgaacctggtgatcgagcggctcaagcaggggctgagcccggtccccgagaccaacgagaagggccaccagctgctgttccacctgtcccccaacgacctggtgtacgtgcccaccatcgacgacaacgagcagctcgacagcaaccgcgtctacaagttcacggacagctccgacacgacctgcaacttcatcccgagcaacatctccgccatcatcttcaacatcaacagcaaggagcaggagaagcgggggatcaactaccccatccagaacgagctgggcgtggggagcccccagagcaagaaccagaagtccttcgacggcttcatgatcaaggaggtctgcatcaagctgaaggtggaccgcctcggcaacatcagcaagacctga

SEQ ID NO: 2231 - RNA, 4416 nt, synthetic construct
  misc_feature 1..4416: note = Cas9 variant
  source 1..4416: mol_type = other RNA
atgtgcaagtacttctacatcaagaacttcatcaccttcgtgctgagcaagtccatcatccccatgaagcacatcctcggcctggacctggggagcaactccatcggctgggccttcgtccagcaggacttcgagaacaagcaggggaagatcatcgccaccggcagccgcatcatcccgatggaccaggggatcctcggcgacttcgagcggggcaacacggtgtcccagaccgcggagcgcaccacctaccggagcacgcgccggctgcgcgagcggcacctcctccgccgggagcgcctgcaccgggtgctgcacatcctcgggttcctgccgccccactacgacgcccagatcgacttcaccaagcgctacggcaagttcatcgacaacgccgagcccaagatcgcctacaacaacgggaacttcatcttcatgaactccttcaacgagatgatcgaggacttcaagaagcaccagccccagctgttctacaagaagtccaacggcgaggagagcaagatcccctacgactggaccatctactacctccggaagaaggccctgagccagaagatcacccagcaggagctggcgtggctcatcctgcacttcaaccagaagcgcgggtactaccagctgcggggcgaggaggagacggagaaccccaacaaggaggtcgccttccactccctcaaggtggtggacgtcgaggccgaggcccccaacaagaagggcgagatctggtacaccatccgcctggagaacgggtggatctaccggcgcaccagcaagatcccgctggacgactggaagggcaagacccgggacttcatcgtgacgaccgacctcaacgacgacgggaccatcaaggtggacaaggagggcaaggagaagcgctccttccgggcgcccgacgagaacgactggaacctgctgaagaagaagaccgagcacgacatcgacttcagcggcaagacggtcggggcctacatctacgaccacctcctgcagaaccccaaccagaagatcaagggcaagctggtgcgcaccatcgagcgcaagtactacaaggacgagctcaaggccatcctggccaagcagatcgccctgcagcccgagctgttcaccgagaccctgctggcggactgcatccgggagctctaccgcaagaacgagacgcagcagcagaacctgctgtccaaggacttcctccacctgttcgtggaggacatcatcttctaccagcggccgctgcgcagcaagaagtccaccatcgccaactgcaccctcgagaagcggagctacatcgacaaggagaccaacgagcgcaaggacgcccccatcaaggtctgcgccaagtccaacccctactaccaggagttccgggtgctgcagtggctgcagaacctccgcatctacgagatcgagacggaccgggaggtgaccgccgagttcatcgagacgccccaggactgcgaggcgctgttcaacttcctgatgagccagaaggagatcgacaacaaggggctcctgaagtacttcctgttcgccaagaacccgcagatcaaggacaaggccgccaagagcgagctcaagaagtggctgaccacctaccgctggaactacgtctacgacgccgcggacaactccagcaagaagtaccccatgaacgagaccggctacgagctgcagcggtacctgcagaaggtggaggggctccccgccaacttcctgaccttcgacatcacctaccagctgtggcacctcctgtactccgtgaaggacaaggtcgagttcgagaaggccctgaagaagttcgccaagaagaagcagctcgacaagacgagcttcgtggactccttcaagaacttcaagccctacccgaacgagtacggcagcttctccgagaaggccatcaagaagctgctgcccctcatgcgcttcggcaaccactgggacttcaaccggatcgacgtgagcacccagaagcgcatcgacgacctgatcaacggggtcgcgaacgaggacatccggaccatcatccgcgagaaggccgagaagtaccagctgaactccgagacctgcttccaggacctccccctgtggctggcccagtacgtggtgtacaaccggcacgccgaggcgacggacatcgagaagtggaccagcgtctccgacctcgaggcctacctggaggacttcaagcagcacagcctgcgcaaccccatcgtggagcaggtcgtgaccgagaccctccgggtggtccgcgacatctggcagcagtacggcgggggccaggccaacttcttcgacgagatccacatcgagctggggcgcgagctgaagaagaccgccgaggagcggaagcagctctccgacaagaaccaggagaacgagagcacgaacctgcgcatcaagaagctgctcgccgagctgaaggaggacgcgtccatccagaacgtgcggccgtacagcctggtgcagcaggagctcctgaagatctacgaggagggcgtcttctccgccaccgacgaggtggaggaggacatccagaagatccgcaagaaggccgagcccagcaaggccgacctgcagcggtacaagctctggctggagcagaagtacaagtccccctacaccggcgaggtgatcagcctgaccaagctgttcacggaggagtacgagatcgagcacatcatcccccagagccgctactacgacgactccctcagcaacaaggtcatctgcgagtccgccgtgaacaagctgaagaccaaccagctcgggctggagttcatccagaaccaccacggcgagaaggtgcggatcaccgcgaacaaggaggtcaccatcttcacggaggagcagtacaaggagttcgtgaagaagcactacgccaacaacagcgccaagcagcagaagctgctcctgaacgagatcccggagaagatggtggcccgccagctgaacgacacccggtacatctccaagtacatcagcgagatcctctccaagatcgtccgcagcgacgagaaggacgagggggtgaactccaagaacatcatcccctgcaccggcaagatcaccacggccctgaagcaggactgggggctgaacgacgtgtggaacaagctcatcctgccccggttcgagcgcatgaaccagctgacccagacccagctgttcaccagctacaacgaccggctccagaagaacctgccgacggtccccatcgagtactcccagggcttccagaagaagcgcatcgaccaccggcaccacgcgatggacgccctcgtgatcgcctgcgccacccgcgagcacatcaactacatgaacaaccagcacgcgctggacaagagcaaggacaagaaggagaagcagcagtcccggatcgacctgcgcaccatcctctgcgagaagaagaacaacaactggcagttcaagaagccctggagcaccttcacgcaggaggccaaggaggccctggagcacatcgtggtctccttcaagcagaacctgcgggtgatcaacaaggccaccaactactacgagaagtgggaggagaagaacggcgtgctcgtcaagaagaaggtgaagcaggaggggaccaactgggccatccgcaagcccctgcacaaggagaccgtgagcggcaagatcgtcctggaccggaagatcgggaaggacaagatcctcacggcgacccgcaaggccgtggacatcaccttcaccgagaagatcatctccagcatcacggacaccggcatccagaagatcctgctgaactacctcaagtacaagggcagcccggaggtggccttctccaccgaggggctggaggagctgaacaagaacatcgcccagtacaacaacggcaagaagcaccagcccatctacaaggtccgcatcttcgaggaggggagcaagttccccctcggcgagaccggggccaaggcgacgaagtacgtggaggccgccaagggcaccaacctgttcttcggcgtgtaccaggggaagggcaagcggacctacgccaccatccccctgaacgaggtcatcgagcgccagaagcaggggctcccgtccgtgcccgagcggaacgagaagggcgagcccctgctgttcagcctctcccccaacgacctggtgtacgtcccgatggagggggagatcgccgagacgatcgacttcaacaacctgagcaaggagcagaaggagcgcatctacaagaccgtgtccttcaccggcaaccagtgcttcttcgtgcaggaggcggtcgccacccccatcgtgaacaagatggagtacagccccctcaacaagatggagcgggacatcctgggcaccatgatcaaggaggtgtgcatcaagctgaaggtcgaccgcctcgggaacatcacgaaggcctga

SEQ ID NO: 2232 - RNA, 4416 nt, synthetic construct
  misc_feature 1..4416: note = Cas9 variant
  source 1..4416: mol_type = other RNA
atgggctacaaggcgccccgcaacgacaagggggagatcgactacggcgtggggctggacctcggcaacgggagcgtcggctgggtggccatggacaaggactaccacctgatccgggcccgcggccacgagctgatcggggcccggctgttcgacccggccaactccgccgagaaccgccgggagagccgcaccacccggcgccggctgtcccgccggcgctggcggctgcgcatgctcgacagcctgttcgcctccgagctggcgaagatcgaccccaacttcctcgcccggcgcaagtacagctgggtgcaccccaaggacgagcagaaccacgagaactggtacggctccatcatcttcgggagcaaggagcaggacaagcagttctacaaggactaccccacgatctaccacctccggaagaagctgaccgaggacaccgagcgccacgacatccgggagatctacgtcgccatccaccacatcgtgaagtaccgcggccacttcctccgggagggggagatcaactccgagaacctgttcgacccggagggcttcgtggagctgatcaaggacgtcatcaagctcaacaacagctacgacgagtccacccccatcttcgaggccagccccgcggacgtgtccgaggccctgctgaacgagcacacgagccgctccggccgcatcgaggacaccctcgacaagctggacttcagcgtgtcccgggtcgacaagcacgagctgaaggggatgcgcgacgccgccaaggccgtgatcggcgcgatcgtggggaacaccgccgacttcagcaagatcttcaacctcgacaacctggacaaggactccaaggacaacctgaagctcaagttcgccgacagcaacttcgacgagaagtacggcggcgtcgtggggagcggcctgctggacgagacccagatcgagctcgtggaccggatccacgccgtctacgacgccgtggcgctgaaggggatcctgggcgacgcccacacgatctccgaggccaaggtggagagctacgagaagcaccgcaagaactggaagctcatcaaggaggagctgcggaccaaggagaacaaggacgaggtcgacctgtggtacggggacctctccggccgccagtacaagaacccgcccgaccccgagaagggccccgacgaggggagcaagaaggactcccccatccgggacagcgaccagaagcagaacctgatcaagaaggccaacgactacttcaccgagctgatcgacgactcccagctcagcgaggagcagaagaactgcctgaagaacgacatcaacaacggccagctgttcccggtgcagcgctccagcgacaacggggtgatcccctaccagatccacctcaacgagctgcggcgcatcatcgagaaccagaagcagtactaccccttcctggccgagaccttcatccggaagacggcggagggcaagtcctacgaggagaacaagatcgtcgccctcctgaagttccgcgtgccctactacgtggggccgctggtcagcaaggaggacatggaggagcactccagcggcaactccgcctaccactggatggcccggaaccccggccgcggggaggccatcaccccctggaacttcgacgaggtggtcgacaaggacgagagcggcgcgcggttcatctcccgcctcaccgggaccgacacgtacctgctgggcgagcccaccctcccgcagcacagcctgctgtacgaggagtacatggtgctgtccgagctcaacaacgtgcggctgaacgtccgccaggggaaccactggagcgacaagaaccggcagcgcctgagctacaagcagaaggagttcctcatcgagaacctgttcaaggagcacaagaccgtgacccgcaagcgggccgaggactgcctgtccagcatgggctgcggcgaggtgcagctgttcgggctgtccgacgagaagaagttcgccagctccctgagctcctacatcacgctcaagaagatcctgggcaaggccttcgtcgacgacagcgggaactccgcgatcctggagcgcatcatcgaggtgcagaccgtgttcgaggaccgggagcccctcacccaccagctgagcctgatcgactccctcaccgtcgagcagcgcaagcagctggccaagatccactacacgggctggggcaagctgagccggaagctcctgacctccaagaaggggagctacaagatccactcccagaacgagatcatgcgcacccagcacagcatcatcgacatcatgcggggcgactccctgaacctcatcgagatcatccgcgacaagaagatcgggatcggcgagtggatcgacaacgagaacctggaccgggagaccggggagagcgacgtgagccgcctggagtccgtgttcgagggcatcgtcatgagcccccgggtgaagcgcggcgtggtccaggccgtgcgggtgatcgacgacctcgccaaggccatcgggaacccgccccagcgcatcttcatcgagatggcggacgaggtccaggcctcccagcggacggtgagccgcctgtcccggctgaaggccctctacggcagcccctccctgcagaaggagttcaacgacctgaaggacctccgcaagagcctgaacgagaccaaggacgccgacctgcaggaggaccggctctacctgtactacatccagctggggaaggacctctacaccggcaaggagatctccatcgacagcctgtccagcgcctacgacatcgaccacatcgtgccccaggcgctgacccaggacgactccatcgacaaccgcgtcctcgtgagccggaaggagaacgcccgcaagacggactcctacctgtacacccccgacctgatcaagaacatgcgcccgctctgggggaagctgctggccgccggcctcatgagccagaagaagtacgacgccctgacccgggtggacgacttcaaggaccgcgagaagcagcggttcgtccagcgctccctggtggagacccggcagatcatgaagaacgtgagcacgatcctccgcacctactacggcgaggacaccaacgtcgtgaccctgaagtccagcatcacccacgacatgcggaagtacctggggttcccctacaagaaccgcgacatcaacgactaccaccacgcgcaggacgccctctgcatcagcgccgccggccagttcatgctgaaccggcacttcgtgtccgggggcgaggtcacggacggggcgagcaacgcctacaacatgtacctggccgagtacctccaggagttccgcgacgccaaggcccggggcgagcgcaagcggtccaccgcgttcggcttcgtggtggggagcatgtccagcaaggacgacgagaagcgcaccgaccaccggaccggcgagatcgtctggtccgagacgaacgccgagtacctgcgcaaggtgatgaactacaagaagatgctgatcacccagaaggtgggggacgtcaagacccgggccctctacgacgagacccgctacggccacaaggagagctccgccaagagcatcaagttcgacaacctgcggcgcgacacgtccctgtacgggggcttcagcggcgcctccaccgcgtacatgatgctcgtggagtacaagaagaagaacaagctggtgagcatcaccgcccaggaggcctccctgctcgccgtcgccgaccagaagaacgacaccgtgagcgtgatggacgggatcctggcgtcccacggcctgagcggggccaagatcctcctgcccaagatcgtcacgggccagctgctcgactactccgacgccctggtgaccctgcagagcgccagcgagctcaacaccgcgcgccagatgtggctgccgcggaacgactacaacgacatcgacatcatcctgaagtccaaggacatcgaggacgccgcccacaagctcggctacgacagcgacaccgtgcacgtcctgcgccggatccagaagctgttcgaggccgtgttccgcgtggccgagtcccagttccccctccaccagctgagcaaggaccagcaggaggagatcctgcgggacccccagaactacgggttcggctccgcggtcaagctcctcgggggcctgctcaaggccctgcacgccaacgccgagaacacgaacctggccgggctcgtgaaggtgctgcacggcgacaaggagtacagcgacgacggcaaggcgaaggagttcaagaagttcgggttcagcccccgctggcggcgcatctccaacccgaccggcttcaccctgtccgacagcgacaccttcatctaccagtcccccagcgggatcttcgagcagcgggtcacggtgaaggagctcaaggagaaggccgacaagcagaagtga

SEQ ID NO: 2233 - RNA, 4422 nt, synthetic construct
  misc_feature 1..4422: note = Cas9 variant
  source 1..4422: mol_type = other RNA
atgaagaacatcctgggcctcgacctggggaccaacagcatcggctgggccctgatcgagaaggacaccgaccagaagaacgggaacatcctcggcacggggtcccgcatcatccccatgagccaggacatcaaggacgagttcggcaagggcaactccatcagccagaccgccgaccggaccaagttccgctccgtgcggcgcctgcgggagcgccacctcctccggcgcgagcggctgcaccgcgtcctgaacgtgctcgggttcctgccgaagcactacgcggaccagatcgacttcaagaagcggctgggcaagctcgtgaacgagaccgagcccaagctggtctacgacaacaagaacttcatcttcaagaagtccttcgaggccatgctgagcgacttcaaccagcaccagcccctcctgctggccgacgggaagaaggtgcccttcgactggacgatctactacctccgcaagaaggccctgaccgagaagatcgagaaggaggagctggcctggctcatcctgaacttcaaccagaagcggggctactaccagctgcgcggggaggaggaggaggagaacccgaacaagatggtggcgttccacagcctcaagatcgtcgaggtgatcgccgacgagtcccagaagggcaaggccgagacctggtacagcctgatcctggagaacggctggatctaccggcgctccagcaagacgcccctctacgactggaaggggaagcagcgggacttcatcgtgaccaccgacctgaacgacgacggctccatcaagaccgacaaggaggggctggagaagcgcagcttccgggcccccgtcgaggacgactggaccctcgtgaagaagaagacggagcaggagatcaaccgctcccacaagaccgtgggcacctacatctacgagaacctgctgcaggaccccaagcagaagatcaagggcaagctcgtccggaccatcgagcgcgagttctacaaggacgagctgaagatgatcctgaagaaccagcagaagttccacccggagctcaacgacgagcacctgtacatcaactgcgtgcgcgagctgtaccggaacaaccaggcgcaccagacgatcctcagcaagaaggacttcgtgcacctgttcatcgacgacatcatcttctaccagcgccccctgcggtcccagaagtccagcatcagcaactgcaccctcgagttccgcaagtacaagaacgagaacgggaccgaccagaccgactacctgaaggccatccccaagagccaccccctgttccaggagttccggctctggcagtggatctacaacctgggcatctaccagaaggaggacgacacgaacgtcaccgacgagctgatcaagaacatcgacgggtaccaggacctcttcgacttcctgaacaacaagaaggagatccgccaggacatcctgatcaagttcctggtggagcagaccggcctcaaggggaagccgctgtccagcgtggtcgccaagtaccggtggaacttcgtggaggacaagatctacccctgcaacgagaccggcacgcagatccgcacccggctggccaaggtggagaacacccccgaggacttcctcaccgccgagacggagatcaagctgtggcacatcatctactccgtcaacgacaaggcggactacgagaaggccctgaagaccttcgccgagaagcacaacctcgacacccacagcttcgtggagaacttcaagaagttcccgcccttcaagtccgagtacggcagcttctccgagaaggccatcaagaagctgctgcccctcatccgcctggggaagtactggagctgggagaacatcgacaagaagacccaggagcggatcgagaagatcctgacgggcgagttcgacgaggccatcaagtcccgcgtgcgggacaaggcgatccacctcaccgaggaggaccacttccaggggctgcagctgtggctcgccagctacgtcgtgtacggccgccactccgaggccgacaacctggacaagtggcacaccgtcgccgacctggaggactacctcgccgagttccggcagcacagcctgcgcaaccccatcgtggagcaggtcatcaccgagacgctgcgggtggtgaaggacatctggctccagtacgggcagggcgcgaaggacttcttctccgagatccacatcgagctggcccgcgagatgaagaacaccggcgacgagcggaagcgcctgaccagcctcgtgaccgacaacgagaacaccaacctgcgcatcaaggtcctgctctccgagctgctgaacgacgggaacgtggagaacgtgcggccctacagcccgatgcagcaggaggccctcaagatcttcgaggacggcgtcctgaactccgacatcgagatcgaggacgacatcctgaagatcagcaagatggcccagcccacgaacaccgagctcaagcgctacaagctgtggctggagcagaagtaccggtccccctacaccgggcagatcatccccctcaaccgcctgttcaccgccgactacgagatcgagcacatcatcccgcagagccggttcttcgacgacagcttctccaacaagatcatctgcgagagcgcggtgaaccagctgaaggacaagcagctcggcctggagttcatcaagaaccactccgggacgatcgtgaagctgggcatgggcaagaccgccaagatcctcgacgtcgagagctacaacgagttcgtgaaggggaactacaccaagaacatctccaagcgcaacaagctgatgctggaggagatccccgacaagatgatcgagcggcagctcaacgacacccgctacatcagcaagttcatcatctccgccctgagcaacatcgtgcggtccgagagcaacgacgacggcttcaactccaagaacgtcctgcccgggaacggcaagatcacgagccgcctcaagcaggactggggcatgaacgacatctggaacgagctgatcctgccccggttcgagcgcatgaacaagatcaccgactccgccgtgttcaccgcgtggaacgagaacaaccagaagttcctcccgatcgtgcccctggagttcagcaaggggttccagaagaagcggatcgaccaccgccaccacgccctggacgccctcgtcatcgccgcctccacccgggagcacatcaacctgctgaacaacgagcacgccaagagcgacaagcgcttcgacctcaaccggaagctgcgcaagttcgagaaggtggcgtacaacgaccccaagacgggcaagcggatcgagaaggaggtgccgaccatcttcctgaagccctgggagaccttcaccgtcgacgccaagaactccctcgagagcatcatcgtgagcttcaagcagaacctgcgcgtgatcaaccgggccacgaactactccgagagctacaacgacgagaacggggccctgcgcctcggcaaggacgggaaccccctgaaggagaagatcaagcagtccaagggcgacagctgggcgatccgcaagcccatgcacaaggacttcgtctacggcaaggtgcacctccagaacgtgaagctgccgaaggacaagttcatcaccgccatccggaagtccctggacgtcaccttcgacctgaagcgcatcgagaccatcacggacaccgggatccagaagatcctcaagaactacctgcacagcaaggagaacaaggtggagctggccttctcccccgagggcatcgaggacatgaaccagcacatcgagcggtacaacgacgggaagaagcaccagcccatccacaaggtgcgcgtcttcgagatcggcagccggttctccctcggggagagcggcaacaagaagaccaagttcgtggaggccgccaagggcaccaacctgttcttcgcggtgtaccaggacgacaacaaggggaagcgcaactacgagacgatccccctgaacatcgtcatcgagcggcagaagctcggcctgcactccgtgccgaccgaggacgccaagggcgggaagctgctgttccacctgagccccaacgacatggtgtacgtccccacctccgaggagctggaggacaacctcgccagcgtgaacatcaagcgcctgaacaccgcccagcggaagcgcatctacaaggtggagaaggcgtccggggtcgagtgctacttcatccggcaggacatcgcctacctgatcaagaactacgacgccaagacgaagatcggcgagctcgagagccagaacaagctgcagaccaccatgaccgacgaccgcctgaagatcacggacgtgtgcgtgaagctcaacatcgaccggctgggctccatcgccgagaccttcctggggaaccagtacggcgccagcaagaagacctga

SEQ ID NO: 2234 - RNA, 4422 nt, synthetic construct
  misc_feature 1..4422: note = Cas9 variant
  source 1..4422: mol_type = other RNA
atggccaagatcctgggcctcgacctggggaccaacagcatcggctgggccgtggtcgagcgcgagaacatcgacttctccctgatcgacaagggggtgcggatcttcagcgagggcgtgaagtccgagaaggggatcgagagctcccgcgcggccgagcggaccggctaccgcagcgcccggaagatcaagtaccgccggaagctccgcaagtacgagacgctgaaggtcctgtccctcaaccggatgtgccccctgagcatcgaggaggtggaggagtggaagaagtccggcttcaaggactacccgctgaaccccgagttcctcaagtggctgagcaccgacgaggagtccaacgtgaacccctacttcttccgcgaccgggccagcaagcacaaggtctccctgttcgagctcgggcgcgccttctaccacatcgcgcagcggcgcggcttcctgagcaaccggctggaccagtccgccgaggggatcctcgaggagcactgccccaagatcgaggccatcgtggaggacctgatcagcatcgacgagatctccaccaacatcaccgactacttcttcgagacgggcatcctggacagcaacgagaagaacgggtacgccaaggacctcgacgagggcgacaagaagctggtgtccctgtacaagagcctcctggcgatcctgaagaagaacgagagcgacttcgagaactgcaagtccgagatcatcgagcgcctcaacaagaaggacgtcctgggcaaggtgaaggggaagatcaaggacatcagccaggccatgctggacggcaactacaagaccctcgggcagtacttctactccctgtacagcaaggagaagatccggaaccagtacacctcccgcgaggagcactacctgagcgagttcatcaccatctgcaaggtgcagggcatcgaccagatcaacgaggaggagaagatcaacgagaagaagttcgacggcctcgccaaggacctgtacaaggccatcttcttccagcggccgctgaagtcccagaaggggctcatcggcaagtgcagcttcgagaagtccaagagccgctgcgccatctcccaccccgacttcgaggagtaccggatgtggacgtacctgaacaccatcaagatcgggacccagagcgacaagaagctgcgcttcctcacccaggacgagaagctgaagctggtccccaagttctaccgcaagaacgacttcaacttcgacgtgctcgcgaaggagctgatcgagaagggctccagcttcgggttctacaagtccagcaagaagaacgacttcttctactggttcaactacaagcccacggacaccgtggccgcctgccaggtcgccgcctccctgaagaacgcgatcggcgaggactggaagaccaagagcttcaagtaccagaccatcaactccaacaaggagcaggtcagccggacggtggactacaaggacctctggcacctcctgaccgtggccaccagcgacgtgtacctgtacgagttcgccatcgacaagctgggcctggacgagaagaacgccaaggccttctccaagaccaagctcaagaaggacttcgcgagcctgtccctgagcgccatcaacaagatcctgccgtacctcaaggaggggctgctgtactcccacgccgtgttcgtcgccaacatcgagaacatcgtggacgagaacatctggaaggacgagaagcagcgcgactacatcaagacgcagatcagcgagatcatcgagaactacaccctcgagaagtcccggttcgagatcatcaacggcctgctgaaggagtacaagagcgagaacgaggacgggaagcgcgtgtactactccaaggaggccgagcagagcttcgagaacgacctcaagaagaagctggtcctgttctacaagtccaacgagatcgagaacaaggagcagcaggagaccatcttcaacgagctcctgcccatcttcatccagcagctgaaggactacgagttcatcaagatccagcggctcgaccagaaggtgctgatcttcctgaagggcaagaacgagaccgggcagatcttctgcacggaggagaagggcaccgcggaggagaaggagaagaagatcaagaaccgcctcaagaagctgtaccaccccagcgacatcgagaagttcaagaagaagatcatcaaggacgagttcggcaacgagaagatcgtcctggggagccccctcaccccgtccatcaagaaccccatggccatgcgggccctgcaccagctgcgcaaggtgctcaacgccctgatcctggagggccagatcgacgagaagaccatcatccacatcgagatggcgcgggagctcaacgacgccaacaagcgcaaggggatccaggactaccagaacgacaacaagaagttccgggaggacgccatcaaggagatcaagaagctgtacttcgaggactgcaagaaggaggtggagcccacggaggacgacatcctgcgctaccagctctggatggagcagaaccggtccgagatctacgaggagggcaagaacatcagcatctgcgacatcatcgggtccaaccccgcctacgacatcgagcacaccatcccgcgcagccggagccaggacaactcccagatgaacaagaccctgtgcagccagcgcttcaaccgggaggtcaagaagcagtccatgcccatcgagctgaacaaccacctcgagatcctgccccgcatcgcccactggaaggaggaggcggacaacctgacccgggagatcgagatcatcagccgctccatcaaggccgccgccacgaaggagatcaaggacaagaagatccgccggcgccactacctcaccctgaagcgggactacctgcagggcaagtacgaccgcttcatctgggaggagcccaaggtgggcttcaagaacagccagatcccggacaccgggatcatcaccaagtacgcccaggcgtacctcaagtcctacttcaagaaggtggagagcgtcaagggcgggatggtggccgagttccggaagatctggggcatccaggagtccttcatcgacgagaacggcatgaagcactacaaggtgaaggaccgcagcaagcacacgcaccacaccatcgacgccatcaccatcgcctgcatgaccaaggagaagtacgacgtcctggcccacgcgtggaccctggaggaccagcagaacaagaaggaggcccggtccatcatcgaggccagcaagccctggaagacgttcaaggaggacctcctgaagatcgaggaggagatcctggtgtcccactacacccccgacaacgtgaagaagcaggccaagaagatcgtccgcgtgcgggggaagaagcagttcgtggcggaggtcgagcgcgacgtgaacggcaaggccgtgcccaagaaggccgccagcgggaagaccatctacaagctcgacggcgaggggaagaagctgccgcggctgcagcagggcgacaccatccgcggctccctccaccaggacagcatctacggggccatcaagaaccccctgaacacggacgagatcaagtacgtcatccggaaggacctggagtccatcaagggcagcgacgtggagtccatcgtggacgaggtcgtgaaggagaagatcaaggaggcgatcgccaacaaggtgctcctgctgagcagcaacgcccagcagaagaacaagctcgtcgggaccgtgtggatgaacgaggagaagcgcatcgccatcaacaaggtgcggatctacgccaactccgtcaagaaccccctgcacatcaaggagcacagcctgctctccaagagcaagcacgtgcacaagcagaaggtgtacggccagaacgacgagaactacgcgatggccatctacgagctggacgggaagcgcgacttcgagctgatcaacatcttcaacctcgccaagctgatcaagcagggccagggcttctaccccctgcacaagaagaaggagatcaaggggaagatcgtcttcgtgccgatcgagaagcggaacaagcgcgacgtggtcctcaagcggggccagcaggtcgtgttctacgacaaggaggtggagaaccccaaggacatctccgagatcgtggacttcaaggggcgcatctacatcatcgagggcctgagcatccagcggatcgtgcgcccctccgggaaggtcgacgagtacggcgtgatcatgctgcgctacttcaaggaggcccggaaggccgacgacatcaagcaggacaacttcaagccggacggcgtgttcaagctcggggagaacaagcccacccgcaagatgaaccacaaccagttcaccgcgttcgtcgagggcatcgacttcaaggtgctgcccagcgggaagttcgagaagatctga

SEQ ID NO: 2235 - RNA, 4425 nt, synthetic construct
  misc_feature 1..4425: note = Cas9 variant
  source 1..4425: mol_type = other RNA
atgaagaagatcctgggcctcgacctggggaccaacagcatcggctgggccctgatcgagtccgacttcgagaagaagcaggggaagatcaacggcctcgggagccgcatcatccccatgtcccaggacatcctgggcaagttcgacagcggcgtgtccatcagccagaccgccgagcggacgtcctaccgcggggtccggcgcctgaaccagcggaacctcctgcgccgggagcgcctgcaccgggtgctcaacatcctggacttcctgccgaagcactacagcaacgcgatcgacttcgagaagaagctcggccagttcaaggagaacgtggaggagaagctgaactacgccaagaaccagatcgggcgccacgagttcatcttcatggactccttcaaggagatggtcaaggagttcaagcagacccagccccagctgttctacaagcgggagaacggcatcgagaccaagatcccctacgactggaccctctactacctgcgcaagaaggccctgagccagaagatcaagaaggaggagctcgcctggatcatcctgaacttcaaccagaagcgggggtactaccagctgcgcggcgaggacgtgctcgacgagtccaagatcgaggacttctacagcctgaaggtggtcgaggtgcaggagacggaggacaagaacgcccggggcacctggtacaacgtgatcctggagaacgactgggtctacaagcgccagtccaaggagagcctcgacaactggatcgggaagaacaaggagttcatcgtgaccaccaacaaggagaaggacggctccctgaagctggacaaggcggggaacgtgaagcggaacttccgcgccgtcgacagcgagaaggactggatcgccatcaagaagaagacggagcaggacgtggagatctccaagcacaccgtgggccagtacatctacgagaccctcctgcagaacgccaagcagaagatcaagggcaagctggtcaagaccatcgagcggaagttctacaaggaggagttcatcaagatcatcaaggagcagctcaagcaccaccccgagctgcagagcaagacgctgtacgagacctgcatccaggagctctacccgcgcaacgaggcgcaccagaacaacatcaagtccaaggggttcgagtacctgttcaccgacgacatcatcttctaccagcggcccctcaagagcaagaagtccaccatcagcggctgccagtacgagacgcgcctcttcaagaagaccgtgctgaacaaggtgaccaacaaggagaacgagatctggcagaaggagcccctgaaggccatcagcaagtcccaccccctcttccaggagttccgcctgtggcagttcctgaagaacctcaagatctaccagaaggaggacgtcaaggggaacctgatcgaccacgacatcaccagcgacctgctcaagacggaggccgactgggtggagctgttcgacttcctgaacatcaagaaggagatcgagcagaagcagatcatccagttcttcatcaacaacaagcagatcgagaagggcaagaagaacaactaccggtggaactacgtggaggacaagaagtacccgtgcaacgagaccaagtcccagctcatcagccgcctgaagaaggtcaagaacctggacctgaacctcttcttcacctccgagaccgagctgaagctgtggcacatcatctacagcgtgaaggacaagatccagtacgagaaggccatcaagaacttcgccatcaagaacaacatcgacatcgactccttcgtggagaacttcaagcggttcccgcccttcaagaacgagtacgcggcctacagcgagaaggccatcaagcgcctcctgcccctgatgcggatgggggagtactggaacgagtccgagatcaagcaggaggtcaaggaccgcgcctacagcatcatcgagcggctcaagggcatcgacttcaacaaggacaagatcgacgagaagatcacggacgacgacatcaagaagcagctgctgaagtccttcatcgacttcaaggacaagaaccccctcaagggcctgaacacctaccaggcctgctacctggtgtacaaccgccacagcgaggtcaactccatcgcgtactggaagtcccccgacgacatcaacaagtacctcgaggggttcaagcagcacagcctgcggaaccccatcgtggagcaggtcgtgaccgagaccctgcgcacggtgcgggacatctggcagtactacggcaaggggaaggccagcttcttcaacgagatccacgtggagctcggccgcgagatgaagaaccccgcctacaagcggaaggcctccaccaaccgcgtcaccgagaacgagaacaccaaccaccggatcaaggagatcctgaaggagctgcagaacgagggggtgcaggaggtcaagagctacagccgcaaccagcaggagatcctcaagatctacgaggagggcatctaccagtccatcgacgtggtggacgacgccatcgagaagatccggaagaacagctccccgacgaaggcggagatcatcaagtacaagctgtggctggagcagggctacaccagcccctacaccgggaagaccatccccatgtccaagctgttcacgaccgactaccagatcgagcacatcatcccccagagcctgtacttcgacaactccctgagcaacaagatcatctgcgagtccgaggtgaaccagctcaaggacaaccagaccgcctacgagttcatcaagaagcacggcaccgagaaggtcagcctggggaagaacaagaccgtggagatcttcacgctggagcagtacgagaagcactgcaaccagtacttcaagaagaacaagaacaagctcaagaagctgctgtccgaggagatcccggagggcttcatcaaccgccagctcaacgacagccggtacatctccaagttcatcaaggggctgctgggcaacctcgtgcgcgaggaggacgagcaggaggtcaccaccaagcacatcgtgcccgtgaccggcgccatcacgagcaagctgaagcaggactgggggctgaacgacaagtggaacgagctcgtcgcctcccgcttccagcggctgaacaccatgaccaacagcaacaacttcggctactgggacaccaagatcaacgccttccgcgtccaggtgcccgacgagatctccaaggggttcagcaagaagcggatcgaccaccgccaccacgcgctggacgccctcgtgatcgcctgctgcacgcggaaccacatcaactacctgaacgccctgaacgcggagaagaagaactacggcctccgcgacctgctgctcatcaagaacgacaagaaccactacaccaagttcttcaagcacccctgggacggcttcccggtggaggccaagagcgtgctggagaagaccatcatctccttcaagcagaacacccgggtcatcaacaagacgaacaacaagacctggcagtgggccgagaaggaggggcagctgaagaaggtgctcgtgaagcagaccaagggcgacaactgggccatccgcaagcccatgcacaaggagaccgtcagcgggaagctgaacatccccacgcccaagggcaagatcgccaccgcgtcccgggtgagcctgtccgagatcaagacccgcaagcagctcgacaagatcaccgacatcagcatccagaagatcctggagcggcacctgaacaactacctcgacgacaaggggaaggagaagttcgacctggccttcaacgccgacggcgtggaggagctgaacaagaacatcaaggtcctcaacaagggcaagaaccaccagccgatctacaaggtgcgcctgtacgagatcgggtcccggttcaaggtgggcaacagcgggaacaagaaggacaagtacgtcgaggccgccaagggcacgaacctgttcttcgcgatctacctcaacgagaaggacaagaagcgcgtgtacgagaccatccccctgaacgaggtgatcgagcaccagaagcaggtctccaacctgcccaagaacgagcggaccccggtgcccgtgaaccacaccaaggggaagttcctcttcagcctgtcccccaacgacctggtctacgtgcccacggacgaggagatcgacaacccgagcctcgtgaacttcaacaacctgaacaagaagcaggtcgagaagatctacaagaccgtgtcctgcagcacctaccagtgcttcttcgtgcacaacaccatctccaagcccatccagaacaaggtcgagttcagcgccctgaacaagatggagaagtccatcgacggcatcatgatcaaggaccgctgctggaagctcaagatggaccggctgggcaacatcatcagcgtgatccgctga

SEQ ID NO: 2236 - RNA, 4443 nt, synthetic construct
  misc_feature 1..4443: note = Cas9 variant
  source 1..4443: mol_type = other RNA
atgaagaccatcctgggcctcgacctggggaccaacagcatcggctgggccaaggtgtgcgtcgacaacgacgggaactacctgcgcgacatcaagctcggctcccggatcatccccatgagccaggacacgctggggaacttcgacaagggcgtgaccgactccccgaccgccgcgcgcaccggcttccgcggggtgcggcggatccgcgagcgggccctgcagcgccgggagcgcctccaccgggtcctgcacgtgatgaagttcctgccgccccactacgagaacgccatcggctggaaccgcgaggaggccacgacctacgggaagttcctcaaccacggcgagcccaagctggcctgggagaagcaggaggacgggagcatgcggttcctgttcatggactccttccacgagatgatggcggacttcgccgagagccagcccggcctcgtggccggcgggaagaagatccccctggactggaccctgtactacctccgcaagaaggccctgacccaggcgatccggaaggaggagctggcctggatcctcctgaacttcaaccagaagcgcggctactaccagctgcgcggggaggaggacgaggagaaccccgccaagcgggaggagtaccacgagctcaaggtcgtgtccgtggaggccgccgaggagggcaagggcgggaacacgtggtacaacgtcaccctggagaacggctggatctaccggcgccagagcaaggtggagctgcacgactgggtggggaagacccggcagttcatcgtcaccacggagtacgagaaggacggcgtgaccatcaagaaggacaagaacggggaggtgaagcgctccttccgcgcgcccagcgaggacgactggggcctccggaagaagcgcaccgagtccctgctggaggacagcggcaagaccgtcggggccttcatctacgaccacatcctctccgagccgacggacaagatccggggcaacttcatccgcaccatcgagcggaagtactacaagaaggagctggaggccatcctgctcgagcagaccaagcaccacaaggagctgaaggaccagaacaccctgatcgcctgcatcaaggagctctaccagagcaacaagccccaccaggactccctgatgaagaaggacatgacgtacctgctcatcaccgacctgatcttctaccagcgccccctcaagagcaagaagtccctcatcgccgactgcccctacgagtactacgagtacaccatcaaggagaccggggagatcaagcggcagggcatcaagtgcatcgccaagagcaacccgtactaccaggagttccgcctgtggcagttcatcatcaacctgcggctgttcgaccgcacggacgacaaggaggtgacctccgagtacctgagcagcatggaggactacaccaagctgttcacctacctcaacgaccggaaggacatcaaccaggagacgctgctgaaggacttcttcaagcagaagaaggtgaagatggggatggagaaggagttccccatccgctggaactacatcgaggacaaggagaagaagtacccctgcaacgagacccggcacgagctcctggcggccctggacaaggccggcatcgaccactcctggctggacgacaaggagcgcttctaccggctctggcacctcctgtacagcgtcgagtccaaggaggaggccgagggcgcgctccgcaagctgaaggacaacgacgacttcgtgaacgccttcctgaaggtgaagcccttcaagaaggactacggggcctacagcgagaaggccgtcaagaagctcctggccatcatgcggatgggcgggctgtggaacgagaccgacatctgcgagcagacccgcaaccggatccagtccatcatcaagggcgagatcgacgagaagatcaaggagcgcatggggcgcacgttctgccagctcagcgacttccagggcctgccggagtggctggcgtgctacgtggtgtacggccggcactccgaggccaccgacatccagcgctggaccaagcccgagaacctcatggcctacatcaacgggttcaagcagcacagcctgcggaaccccatcgtcgagcagtgcatcctggagaccctccgcacggtgcacgacatctggaaggaggccggccacatcgacgagatccacgtcgagctggggcggtccatgaagtccaccgcggaccagcgcgcccggatgagcaagagcatcctgcagaacgagaacaccaacctccgcatcaagtccctgctgatggagctcaagaacgccaaggagatcgagaacgtgcggccctacagcccgatgcagcaggagatcctgcgcatctacgaggagggcgccctgcaggagctcaccaaggaggacgcccagtaccccgagatctccaagatcagccagatggcgcagccctccgccaaggagctgctgaagtaccggctctggctggagcagaagtactgcagcccctacaccggcaagccgatctccctgagcaagctgttcacgagcgcctaccagatcgagcacatcatcccccagtcccgctacttcgacgacagcttcaccaacaaggtgatctgcgagaccgaggtcaaccagctgaagtccaacatgctggggtacgagttcatcaagaagcacagcggcgagatcgtgcactgcaccacgatcggggacgtgaagatcctcgacgccaaggagtactacaacttcgtcaccgagcactacgccaacaaccggcgcaagaaggagaagctgctgctcgaggacatcccccaggagttcctgaaccggcagatgaacgactcccgctacatcagcaagaaggtgatggcgatcctgtccaacatcgtgcgggaggaggacgagcaggagaccaacagcaagttcgtcgtgtcctgcagcggcgggatcaccgaccgcctcaagcaggactggggcctgaacgacgtgtggaactccatcgtctacccccggttcgagcgcctgaacaagctcacgcagaccgaggccttcggccggtgggagaacaaggaggggaagcaggtcttccagaccagcctgccgctggagctccagcgcggcttctccaagaagcgcatcgaccaccggcaccacgccatggacgccctggtgatcgcctgcgcgagccgcaacatcatcaactacctgaacaacgagtccgccaagagccaggagcagcgggaggacctccgcaagaagctgtgcgacaagaaccggatcatccgcaagccctgggagaccttcacgcaggacgcccggaccgccctggaggacgtggtggtgtccttcaagaactacgtccgcgtgatcaacaaggcgaccaactactacgagaagtacgacgagagcgggaagaagggcatggccgagcagaaggggcaggacatgtgggccatccggaagcccatgcacaaggagaccgtgttcggccaggtcaacctccgccggaaggtgacggtgaagctgaaggacgccctggagaacatcccggccatctgcgacaaggcgctccgcgactacgtcaacgacctgatcgccaagaagttcaacaccaagcagatgctggcccacttcaagagcatcaactaccggctcaacatgaagtccgtgaacaaggtgggcatctgggtcttcagcgacgagaaggagcccatggtggccacccgcaaggccatcgacatctccttcgacgcgaagcggatcgacaccatcacggacaccgggatccagcagatcctgtgcaagtacctcaagagcaagggcaacgaccccaacgtggccttcacccccgaggggatcgccgagatgaacaagcacatcatcgactacaacaacggcaagcagcaccagccgatcctgaaggtccgcgtgtccgagcccaagggggccaagtaccaggtgggcgagaccggcaacaagacgaagaagttcgtcgaggcccagaaggggaccaacctgtacttcgcgatctacgaggacaaggacggcaaccggagctacaacaccatccccctgaacgaggtggccgagcgcctcaagcaggggctgtcccccgtgccggagaagaacgagaagggcatcagcctgaagttctacctctcccccaacgacctggtctacgtgcccaccgaggaggagaagctgagcaacgagtgcaagctctccaaggagcggatctacaagatggtgagctccacgagcaacgagtgccacttcatcccctacaccaccgccaagccgatctacgacaagttcgagtacgaggccaagaacaagatggggcgcgcgctgaccggcgagatgatcaaggccgtctgctggaagctggaggtggaccgcctcggcaacatcctgaagatcatcaagtga

SEQ ID NO: 2237 - RNA, 4452 nt, synthetic construct
  misc_feature 1..4452: note = Cas9 variant
  source 1..4452: mol_type = other RNA
atgaagaccatcctgggcctcgacctggggaccaacagcatcggctgggccaagatctccatcgacgacaacgggaactacctgcgcgacatccagatgggcagccggatcatccccatgtcccaggacgtgctcgggaacttcgacagcggcgtcacggagtcccagaccgccgtgcgcaccggcttccgggggctgcgccggatccgcgagcggagcctgctccgccgggagcgcctgcaccgggtgctgcacgtcatgggcttcctcccgccccactacgactccgcgatcgggtggaacaaggaggagcccaccacgtacggcaagttcctgaaccacggggagcccaagctggcctgggagcgccagggcgacggcagcatgcggttcctcttcatggactccttccacaagatgatggaggacttcgccccgcaccagcccgccctggtggccgacgggcgcaagatccccctggactggaccctctactacctgcggaagaaggcgctgacccagcccatcaagaaggaggagctcgcctggatcctgctgaacttcaaccagaagcgcggctactaccagctccgcggggaggaggaggaggagaacccgaccaagcgggaggagtaccacgagctgaaggtggtcagcgtggaggccgccgaggagggcaagggcgggaacacgtggtacaacgtgaagctggagaacggctggatctaccggcgctccagcaagatccccctcgacgactgggtcgggaagacccggcccttcatcgtgaccaccgagtacgaggcggacggcatcacgctgaagaagaacaaggagggggaggtgaagcgctccttccgcgcccccggcgaggacgactggggcctgcggaagaagcgcaccgagagccagctcgaggcctccgggaagaccgtcggcgccttcatctacgaccacctcctggccgagccggcggacaagatccgggggaacttcatccgcaccatcgagcggaagtactacaagcaggagctggccgacatcctgcgcgagcagagcaagtaccacgaggagctgcagtccaagaagatcctcgccgactgcgccgaggagctgtaccggagcaaccagccccaccgcgactccctgctcaagaaggacatggtgtacctgctgctcacggacatcatcttctaccagcggcccctcaagagcaagaagtccctgatcgccgactgcccctacgagtactacgagtacgtggacaaggagaccggcgagatcaagcgccaggggatcaagtgcgtcgccaagagcaacccgtactaccaggagttccggctgtggcagttcgtgctgaacctgcgcctctacgaccggaccgaggacaaggaggtgaccgcggagtacctgcccagcaaggaggactacgcccgcctgttcgtctacctcaacgaccggaaggagatcaaccaggagacgctgctgaaggacttcttcaagctgaagaaggtgaagcagcgctccgagaaggagttccccgtgcggtggaactacatcgaggacaaggagaagaagtacccctgcaacgagacccgccacgagctcctgatggccctggaccgggccggcatcgagcgcagctggctcgacgacaccgcgcgccagtgccggctgtggcacctcctgtactccatcgaggtcaaggacgaggccgagcgcgccctgcggaagctgaaggacgacgacgagttcgtgagcgccttcctcaaggtgaagccgttcaagaaggactacggcgcctactccgagaaggcggtcaagaagctgctggccgtgatgcgcatggggagccactggtgcgaggacgacatctgcaaggagaccaaggagcggatcgagcacatcctccagggcgacgtcgaggagaagatcaaggagcgcatgaaccacacggcctactccctgggggagctgagcgacttccaggccctccccgagtggctggcgtgctacgtggtgtacggccggcactccgaggccaccgacatcaagcactggaagacccccgagagcctgatggcctacatcaacgggttcaagcagcactccctccgcaaccccatcgtcgagcagtgcatcctggagaccctgcggacggtgcacgacatctggaaggaggccggccacatcgacgagatccacgtggagctcggccgcagcatgaagtccaccagcgaccagcgggcccgcatgaccgagaacatcctgcggaacgagaacaccaacctgcgcatcaagtccctcctgatggagctgaagaacgacgcggacatcaaggacgtccggccgtacagccccatgcagcaggagatcctccgcatctacgaggagggggccctgcaggagctgacgaaggaggacaacgactacgaggagatcttcaagatctccaagatgccccagcccagcgccaaggagctcctgaagtacaagctgtggctcgagcagaagtaccggagcccgtacaccggcaagcccatctccctgagcaagctgttcacctccgcctaccagatcgagcacatcatcccccagagccgctacttcgacgactccttcaacaacaaggtgatctgcgagagcgaggtgaacgccctcaaggggaacatgctgggctacgagttcatcaagaaccacggcggggagatcgtccactgcaccctgctcggcgacgtgaaggtgcagaacgagtccgagtacaaggcgttcgtcacggagcactacgccaacaacaagtacaagaaggagaagctgctgatggaggacatcccgcaggacttcctcaaccggcacctgaacgacagccgctacatctccaaggtggtgaagaccctgctcagcaacatcgtccggaccgaggacgagatggagaccacctccaagttcgtggtgagctgcaccgggggcatcacggaccgcctgaagaaggactgggggctgaacgacgtctggaactccatcgtgtacagccgcttcgagcggctcaacgagctgaccaagtccgacgccttcggccgctgggagaacaaggagggcaagcgggtgttccagaccagcgtccccctggagctccagcgcgggttcaacaagaagcggatcgaccaccgccaccacgccatggacgccctggtgatcgcgtgcgcctcccggaacatcatcaactacctgaacaacgagagcgccaacagccccaagaagcgcgaggacctccggcagcagctgtgcgacaagaaccgcatcatccggaagccctgggagtccttcacgcaggacgcccgcgcggccctggaggacgtggtcgtgagcttcaagaactacgtgcgggtcatcaacaaggccaccaactactacgagcgctacgacgccgacggcaagaagaccatcaccaagcagaagtcccgggagatgtgggccgtgcgcaagccgatgcacaaggagacggtgttcgggcacgtcaacctccggcgcaaggcgatcgtgaagctgaaggacgccctggagaacatccccagcatctgcaacaaggagctccgggactacatcaacggcctggtggagcgcaacttcaacaccaagcagctgcacgcccacttccgctccaccgactaccggtggaacaagcagaacgtcgacaaggtggaggtgtggcgcttcagcgacgagaaggagcccctcgtcgccacccggaagcccctggacacgtccttcgacgccaagcgcatcgacaccatcaccgacaccgggatccagaagatcctgctcaactacctggaggcgaagggcggcgacccgctgatcgccttcacgcccgaggggatcgccgagatgaaccagaacatcgccctctacaacgacggcaagatgcaccagcccatcctgaaggtgcggatcagcgagcccaagggggccaagtaccagatcggccagaccgggaacaaggcggacaagttcgtggaggcccagaagggcaccaacctgtacttcgccatctacgaggacgaggaccgcaaccggacctacaacacgatcccgctcaacgaggtcgccgagcgcctgaagcagggcctgccgcccgtgcccgagaagaacgagaaggaggtgcccctcaagttctacctgtcccccaacgacctggtctacgtgcccaccgaggaggagatcctcatgaaggagtgcaagctgaacaagaaccggatctacaagatggtgagctccaccgggaaccagtgcttcttcatccccttccgcgtcgcggtgagcatcgtgaacaagatggagtactccccgctgaacaagatggagaaggccatcagctccgagatgatcaaggccgtctgctggaagctcgaggtggaccggctgggcaacatcatccgcgtggtcaagtga

SEQ ID NO: 2238 - RNA, 4452 nt, synthetic construct
  misc_feature 1..4452: note = Cas9 variant
  source 1..4452: mol_type = other RNA
atgaagaccatcctgggcctcgacctggggaccaacagcatcggctgggccaaggtgtccctggacgacaacgggaactacctccacgacatcaagctgggctgccgcatcatccccatgagccaggacgtcctggacaacttcgggaagggcgtgacggtgtcccagaccagcgtccggaccggcttccgcggggtgcggcgcatccgggagcgctccctccagcggcgcgagcggctgcaccgcgtgctgcaccggctcggcttcctgccgcagcactacgacgccgcgatcgggtgggacagcgactgcgccaagacctacggcaagttcctggacaacggggagcccaagctcgcctgggagcgccaggaggacggctccatgcggttcctgttcatgaacagcttctacgagatgatcgccgacttcacgtcccaccagcccgccctggtcgcggacggcaagaagatccccctcgactggaccctgtactacctgcgcaagaaggccctcacccaggccatccggaaggaggagctggcctggatcctgctcagcttcaaccagaagcgcgggtactaccagctgcggggcgaggaggaggacgagaacccgaccaagcgcgaggagttctgcgagctgaaggtggtggcggtcgaggccgccgagaaggggaagggcgacgacatctggtacaacgtgcacctcgagaacggctgcatctaccggcgctccagcaagatctccctggacgactgggtggggaagacgaagcagttcatcatcaccaccgagtacgagaaggacggcgtcacccccaagaaggacaaggacgggaaggagaagcggagctaccgcgcccccaaggaggacgactggggcctgcgcaagaagcggacggagaccgacctcgaggcctccgggaagaccgtgggcgcgttcatctacgagcacctcctggccgagcccttcgacaagatccgcggcaacttcatccacaccatcgagcggaagtactaccgcgccgagctggaggccatcctgacggagcagcggaagtaccacgaggagctgcgcagcgagcagatgctcgccgtgtgcgcggaggagctgtaccggtccaacctgccgcaccagcagagcctcctgaagaaggacatggtctacctgctcctgtccgacctgatcttctaccagcgccccctcaagagcaagaagtccctgatcgccgactgcccctacgagtactaccggtacgtggacaaggagaccggggagatcaagaagcagggcatcaagtgcatcgccaagagcaacccctactaccaggagttccgcctgtggcagttcgtgctcaacctgcggctgttcgaccgcatgaccgacaaggaggtcaccgccgactacctcccgacgaaggaggactacgtgcggctgttcgactacctgaacaaccgcaaggagatcaaccaggagaccctgctcaaggacttcttccggctgaagaaggtgaagctggggcgcgagaaggagttcgagatccggtggaactacatcgaggacaaggagaagaagtacccctgcaacgagacccgctacgagctcctggtcgccctggaccgggcgggcatcgaccgcagctggatcgacgaggacgggcgccagtaccggctctggcacctcctgtactccatcgaggtgaaggccgaggccgagagcgccctgcgcaagctgaactccgacgacgccttcgtgagctccttcctgaaggtcaagcccttcaagaaggactacggcgcgtacagcgagaaggccgtgaagaagctcctggccgtcatgcggatgggctccatgtggagcgaggccaacatctgcgaggagacccagaaccgcatccggtccatcatccgcggggacatcgaggagaagatcaaggagcggatgggccacacggcgcgcagcttcaaccagatcgacgacttccaggccctgcccgagtggctcgcctgctacgtggtgtacgggcggcactccgaggtcaccgacatccagcactgggagaccccggagcagctgcagagctacatcaacggcttcaagcagcactccctgcgcaaccccatcgtggagcagtgcatcctcgagaccctgcggacggtgcacgacatctggaaggaggccgggcacatcgacgagatccacgtcgagctgggccgcgacatgaagcggaccgccgaccagcgcgcgcggatgaccaagaacatcctcaagaacgagaacaccaacctgcgcatcaagagcctgctcatggagctgaagaaggacacggacatcaaggaggtgcggccctactcccccatgcagcaggagatcctgcgcatctacgaggagggcgccctcctgcagctgaagcgggacgacgaggccttcgccgacatcagcaagatctcccagatggcccagccgaccgcgaccgagctccgccggtacaagctgtggctggaccagaagtaccgcagcccctacaccgggaagttcatcagcctctccaagctgttcacgagcgcctaccagatcgagcacgtgatcccccagtcccgctacttcgacgacagcttctccaacaaggtcatctgcgaggccgaggtgaaccggctcaagagcaacatgctgggctacgagttcatcaaggcccacgggggcgagatcgtgcactgcaccatgctgggcgacgtcaagatcctgtccgagagcgagtacaaggccttcgtgaacgagcactacgtgaaccaccgcgcgaagaaggagaagctcctgatggaggacatcccccaggagttcctgaaccggcagatgaacgactcccgctacatcagcaaggtcgtgaaggccctcctgtccaacatcgtgcggaccgaggacgagatggacgtcaccagcaagttcgtggtgccgtgctccgggggcatcaccgaccgcctgaagaaggactgggggctcaacgacgtctggaacagcatcgtgtacccccggttcgagcgcctgaaccggatgacgggcaccgaggccttcgggcactgggagaacaaggagggcaagcgcgtgttccagacctccgtccccatcgagctgcagctcggcttcagcaagaagcggatcgaccaccgccaccacgccatggacgcgctggtgatcgcctgcgcctcccggaacatcatcaactacctgaacaacgagagcgccaacagccagaagaagcgcgaggacctccggcgcctgctgtgcgacaagaaccggatcatccgcaagccctgggagtccttcacccaggacgcccgggtggcgctccaggacatcgtcgtgagcttcaagaactacgtgcgcatcatcaacaaggccacgaactactacgagcgctacgacgagcaggggaagaagaccaccgccgagcagaagtccagcgagatgtgggccatccggaagccgatgcacaaggagaccgtcttcggccacgtgaacctgaagcgcaagacgaccgtgaagctgaagaacgccatcgagaacatccccaacatctgcaacaaggagctcaaggcgtacatcaacgagctggtcgagaagcacttcaacaccaagcagatgctggcccacttcaagtccatcaactaccggtggaaccgccagaacgtggagaaggtggaggtctggcagtacagcgacgagaaggagcggatggccgccacccgcaagcccctcgacacgtccttcgacaagaagcggatcgagaccatcaccgacaccgggatccagaagatcctgctgaactacctcgaggagaagggcggggacccgaacatcgccttcacgcccgagggcatcgcggagatgaacaagaacatcagcctgttcaacgacggcaagctgcaccagcccatcctcaaggtgcgcgtggccaagaccatgggggccaagtaccaggtcggccagaccgggaacaaggccgcgaagtacgtgggcgcccaggaggggaccaacctgtacttcgccatctacgagaacgaggagggcgagcggtcctacaacgccgtgcccctgaacgaggtcgccgagcgcctcaagcagggcatgagcccggtgcccgagaagaacgagaaggacgtgcccctgaagttctacctgtcccccaacgacctcgtctacgtgccgacggaggaggacaagctgagcaacgagtgcaagctggacaacgagcggatctacaagatggtgtccgcgaccgggaagaagtgccacttcctcccctacagcgtcgccaacatcatctacaacaaggtggagttcgagtccatgaacaagatgggcaaggccctgagcggggagatgatcaaggccgtgtgctggaagctggaggtcgaccgcctcggcaccatcctgcgggtgatcaagtga

SEQ ID NO: 2239 - RNA, 4452 nt, synthetic construct
  misc_feature 1..4452: note = Cas9 variant
  source 1..4452: mol_type = other RNA
atgaagaccgagctggacctcaacaaggaccgcctgtacaagcacgtgctgggcctcgacctgggggtcaccagcatcggcttcgcccacgtggtggagtccgagaaccggaacgagagcgagatcaagcagatcggggtccgcgtgatccagctggacaacttcgacaaggtggacaagtccggcaagacgagcgagtccaagaaccccgccgtcgacttcgcggccgggaagggcctcaccccgaacggcagccggaccaagaagcgcggggcccggcgcaacctggaccggtaccaggaccgccgggacaacctgctcgaggtgctgaccaagtccggcttcatcaacagcgagacgaagcgcaccgaggacgggaagcacaccacccaccagacgtgggagatccgggccaaggccgtgtccgagaaggtcgagaaggaggagttcgcgcgcatcctgctcgccatcaacaagaagcggggctacaagagctcccgcaaggccaagaacgaggacgaggggcaggccgtggacggcatggcggtggccaagcggctgtacgaggagaacctgacccccggccagtacgcctacgaggtcctcagcgggggcaagaagtccatccccgacttctaccgcagcgacctgcaggccgagttcgacaagatctggaacttccagaagcagttctaccccaacatcctgaccgacgagttctacgaggagctcaaggggaagggccagcgggccacctccgcggccttctggaagatccaccagttcaacacggccgacatcaaggacctggaggacgagctgaagaacgagcgcaccatcaagctcagcaagcgggaccagaagaagctgcaggcctacaagtggcgctccgaggccgtggtgaagcagctgggcaaggaggaggtcgcgtacgtgctcaccgagatcaacaacaacctgaacaacagctccgggtacctgggcgccatcagcgaccggagcaaggagctctacttcaacaagcagaccgtggggcagttcctgtacaagcagctgaaggagaacccgcacacgcgcctcaagaaccaggtcttctaccgccaggactacctggacgagttcgagaccatctgggagatgcaggcccagttccaccccgagctgacccaggagctcaaggaggagatccgggacatcatcatcttctaccagcgcaagctgaagtcccagaagggcctgatcagcttctgcgagctcgagtccaaggaggtggtgatcaacgacaccaagaagatcatcgggctgcgggtcgcccccaagagcagccccctgttccaggagttcaagatctggcagaacctcaacaacgtgctggtgcgcaagaagggcagccggaagcgcatggtcaaggcccagaaccagcactccctgttcgaggagccgaaggagatcttcagcctcgacctggcgtccaaggagaagctgttcgaggagctcaacctgaagggcaacctgagcgccaagaactgcctcgacatcctggggctgaactccaacgagtgggagctgaactacacgcagctcgagggcaaccggaccaacaagagcctgtacgaggccttcctgaagatcctcgacatcgaggggtacgacgtgaaggacctgctgaaggtcaagtccagcaaggacgaggtggagctcgacgacctgaaggtgcccgcctccgagatcaagaacatggtccgcgagatcttcagcaccaacaagatcgacaccgagatcctggacttcgacgccgagatcgacggcaaggcgttcgagaagcagtccagctaccagctctggcacctcctgtactcctacgagggggacgacagccagagcggcaacgagaagctgtacgagctgctggccaagaagttcggcttcaagcgggagcacgcccagatcctcgccaacgtgtccctggtggacgactacgggaacctgagctccaaggcgatgcgcaagatctacccccacatccgggagaacaactacagcacggcctgcgagctcgtcggctaccgccactccaagcacagcctgaccaaggacgagctgaaggaccgggtgctcgaggaccgcctggagctgctcaagaagaactccctgcggcagcccgtggtcgagaagatcctgaaccagatgatcaacgccgtgaacgccctcatcgagaagaacagcgagcgcgacgagaacgggaacatcaccaagtacttcaagttcgacgagatccggatcgagctggcccgcgagctgaagaagaacgcggccgagcgggccgagatgaccacgaacatcaacgccgccaagctcgtgcacgagaagatcttcaagatcctgcagaacgagttcggcatcaagaacccgacccgcaacgacatcatccgctaccggctgtacgaggagctcaaggggaacggctacaaggacctgtactccaacacctacatcccccgcgagatcctgttcagcaaccagatcgacatcgaccacatcctcccccagtcccggctgttcgacgacagcttctccaacaaggtcgtggtgttccgcaaggacaacctgaagaagggcaaccagaccgcgatcgactacatcgggagcgaggtcggcgaggaggggctcaagaacttcatcgagcgggtggagtccctgtacgagctgggcaagaagaacaaggaggagggcatcagcaaggccaagtaccagaagctcctgaagtccgccagcgagatcggggacggcttcatcgagcgcgacctgcgggagagccagtacatcgccaagaaggccaaggagctcctgttcaaggtgacgcgctccgtcgtgagcacctccgggagcatcaccgaccggctgcgcgaggactggggcctcatcaacgtgatgaaggagctgaacctgcccaagtacaagtccctcgggctgaccgagatccaggagcggcgcaacggccaccaggtcgaggtgatcaaggactggacgaagcggaacgaccaccgccaccacgcgatggacgccctggccgtggccttcaccaagcacaaccacatccagtacctcaactacctgaacgcgcggaagaacgagagccacaagctgcacggcaacatcatcgccatcgagaccctcgagaccgaggtcaagatcgacgacctggggaacaagaagcgcgtgttcaaggagccgatccccaacttccgccaggtggccaaggagcacctggagaacgtcctcatctcccacaaggccaagaacaaggtggtgaccaagaacaagaacaagatcagcggcaaggagaagctgcagatcacgctgacgccccgggggcagctccacaaggagaccgtctacggcaagtaccggttctaccagtccaaggacgagaaggtgagcgccaagttcgacctggagaccatcgagaaggtggcgaacccctcctacaaggccgccctgctccagcgcctgaacgagaacgagaacgacccgaagaaggccttcagcgggaagaacgccctgtccaagaaccccatctacatcagcatggagaacgacatcaaggtccccgacaccgtgaagctcgtgtggctggaggaggactactccatccggaaggacgtcacccccgagaacttcaaggacgagaagtccatcgagaagatcctggacgagggcgtgaagcgcatcctcaagaaccgcctgaaggagttcggcggggacgcgaaggaggccttctccgacctggacaagaacccgatctggctcaacgaggagaagggcaccagcatcaagcgggtgcgcatctccggggtcaagaacgccgagcccctgcactacaagaaggaccacttcggcaacgacatcctggacgggaacggcaacaagatccccgccgacttcgtgagcaccggcaacaaccaccacgtggccatctacaaggagcccgagttcgacaagaaggggcagccggtcctcgacgagctgggcaaccagaagtacaacctgcaggagaaggtggtgagcttcttcgaggcggtcgagcgggtgaaccaggggctccccatcatcgacaagacgtacaaccagcacctgggctggcagttcttcttcaccatgaagcagaacgagatgttcgtgttccccaacgagaagacccgcttcaacccgatcgagatcgacctgctcgaccccaacaacaagaagctgatctccctgaacctcttccgggtccagaagatcgccaacaagaactacatgttccgccaccacctggagaccaacgtggacgacaagaaggagatgaagaacatcgccttcatccacatccagagctgcaacctgctcaaggagatcatcaaggtgcggctgaaccacctgggggacatcgtctccgtgggcgagtactga

SEQ ID NO: 2240 - RNA, 4452 nt, synthetic construct
  misc_feature 1..4452: note = Cas9 variant
  source 1..4452: mol_type = other RNA
atgaagaccatcctgggcctcgacctggggaccaacagcatcggctgggccaaggtgtccgtcgacgaccacgggaactacctgcacgacatcaagctcggcagccgcatcatccccatgtcccaggacatcctggggaacttcgacaagggcgtgacggagagccagaccgccatccggaccggcttccgctccgtgcggcgcatccgggagcgcagcctgctccggcgcgagcggctgcaccgcgtcctgcacgtgatggggttcctcccgccccactacgactccgcgatcggctggaaccgggaggaggccagcacctacgggaagttcctgaaccacggcgagcccaagctggcctgggagcgcctcgaggacgggtccatgcggttcctgttcatggacagcttccacgagatgatggccaacttcgcccgccaccagcccgcgctggtggccgacggccggaagatcccgctcgactggacgctgtactacctgcgcaagaaggccctctcccaggccgtcggcaaggaggagctggcgtggatcctgctcaacttcaaccagaagcgggggtactgccagctgcgcggcgaggaggaggaggagacccccaccaagcgggaggagtactacgagctgaaggtggtgagcgtcgaggccgccgaggaggggaagggcggcaacacctggtaccgcgtgcagctcgagaacgggtggatctaccggcgcccctccaagatcgccctggacgactgggtgggcaagacgaagcagttcatcgtcaccaccgagtacgagaaggacgggaccacgctgaagaaggacaaggacggcgaggtgaagcgcagcttccgggcccccggggagaacgactggggcctccgcaagaagcggaccgagtcccagctggaggcgagcggcaagaccgtgggggccttcatctacgaccacctcctcgccgagccggccgacaagatccgcggcaacttcatccggaccatcgagcgcaagtactacaagcaggagctggaggccatcctgcgggagcagacgaagcaccacgaggagctccgctccaaggagatgctggcgaagtgcgccgaggagctgtaccagagcaaccagccccaccggaagtccctcctgaacaaggacatgacctacctgctcctgaccgacctgatcttctaccagcgccccctcaagagcaagaagtccctgatcgccgagtgcccctacgagtactacaagtacaaggacaaggagaaggggaagaagaagcggcagggcatcaagtgcgtcgccaagagcaacccgtactaccaggagttccgcctgtggcagttcatcgtgaacctccggctgttcgaccgcaccgacgacaaggaggtgacggccgagtacctgcggagccgcgaggactacgcgcggctgttcgcctacctgaacgaccgcaaggagatcaaccaggagaccctgctgaaggacttcttcgggctcaagaaggtcaagatcggcgccgagaaggagttcgccatccggtggaactacatcgaggacaaggagaagaagtacccctgcaacgagacccgccacgagctgctgctcgccctggaccgcgcgggcatggaccggtcctggctggacgacagcgagctccagtaccgcctgtggcacctcctgtactccgtggaggcccgggacgaggccgagggggccctgcgcaagctgcgggacgacgacgagttcgtgggcgcgttcctcaaggtcaagcccttcaagaaggactacggggcctacagcgagaaggccgtgaagaagctgctggccgtgatgcgcatgggctcctggtggcacgaggaggacatctgcaagcagacccgggaccgcatcgagcggatcgtccagggggacatcgaggagaagatccgcgagcggatgggccacgccgcgtacagcttctcccgcctcgccgacttccagggcctgcccgagtggctggcctgctacgtggtctacgggcggcacagcgaggccacgcacatcctccgctgggactccccggacaagctgctgagctacatcaagggcttccggcagcactccctccgcaaccccatcgtggagcagtgcatcctggagaccctgcggaccgtgcacgacatctggaaggaggccgggcacatcgacgagatccacgtcgagctcggccgcagcatgaagtccaccgcggagcagcgggcccacatgacgaagaacatcctgcgcaacgagaacaccaacctgcggatcaagtgcctcctgatggagctgaagaacgacgccgacgtgaaggacgtgcgcccctacagccccatgcagcaggagatcctccgcatctacgaggagggcgccctgcagcagctgaccaaggacgacgccgagtacgcggagatctccaagatcagcaagatggcccagccgtccgccaaggagctcctgcggtacaagctgtggctcgagcagaagtaccgcagcccctacaccgggaagcccatcagcctgtccaagctgttcacgagcgcctaccagatcgagcacgtcatcccccagtcccggtacttcgacgacagcttcaacaacaaggtgatctgcgagtccgaggtgaacaccctcaagagcaacatgctgggctacgagttcatcaagaaccactgcggggagatcgtccactgcaccatgctgggcgacgtgaaggtgttctccgagagcgagtacaaggcgttcgtcaccgagcactactccaacaacaagtacaagaaggagaagctcctgctggaggacatcccgcaggagttcctcaaccgccagatgaacgacagccggtacatctccaaggtggtgaaggggctgctgagcaacgtcgtgcgcacggaggacgagctcgaggccacctccaagttcgtggtcagctgcaccggcggcatcaccgaccggctgaagaaggactgggggctgaacgacgtgtggaactccatcgtgtacagccgcttcgagcggctcaacggcctgaccaagtccgagcacttcgggcactgggagaacaaggagggcaagcgcgtcttccagacgagcgtgcccatggagctgcagcgggggttcaacaagaagcgcatcgaccaccggcaccacgccatggacgccctcgtgatcgcctgcgcgagccgcaacatcatcaactacctgaacaacgagttcgccaagtcccccaagcagcgggaggacctgcgccagctcctgtgcgacaagaaccggatcatccgcaagccctgggagaccttcacccaggacgcccgggccgccctggaggacgtcgtggtgagcttcaagaactacgtccgcgtgatcaacaagaccacgaactactacgagcgctacgacgcggacggcaagaagaccatggtgccgcagaagggcaacgagatgtgggccgtccggaagcccatgcacgaggggaccatgtacggccgcgtgaacctccggcgcaaggccgtggtcaagctgaaggaggccctggagaacatctccagcatctgcaacaaggagctccgggactacatcaacgtgctggtggagaagcagttcaacaccaagcagctgctcgcccacttcaagtccatggactaccgctggaacaagcagcacatcgacaaggtcgaggtgtggcggttcagcgacgagaaggtgcagatggtcgcggcccgcaagcccctggacacgtccttcgacaaggagtgcatcgccagcatcaccgacaccgggatccagaagatcctgctcaactacctggagtccaagggcggggacccggccatcgcgttcaccagcgagggcatcgccgagatgaaccagaacatcgccgtgtacaacgacggcaagaagcaccagcccgtgatcaaggtccggaagtccacgaagctggggaagaagttcgccgtgggccagatcgggtgcaagagcaagcagttcgtggtcgccgaggcgggcaccaacctctacttcgccatctacgaggacgaggaggggaagcgctcctacgacaccatccccctgaacgaggtgaccgagcggctgaagcagggcctcagccccgtgccggagaagaacgagaaggaggtccccctgaagttctacctgtcccccaacgacctcgtgtacgtgcccacggaggacgagatgcagatgaaggagtgcaagctgaacaaggagcgcatctacaagatggtcagctccaccggcaacgagtgccacttcctgccgtacagcgtggcctccgtcatctacaacaaggtggagttcgagagcatgaacaagatggggcgggccctcaccggcgagatgatcaaggccgtgtgctggaagctggacgtcgaccgcctggggaacatcctccgggtgatcaagtga

SEQ ID NO: 2241 - RNA, 4452 nt, synthetic construct
  misc_feature 1..4452: note = Cas9 variant
  source 1..4452: mol_type = other RNA
atgaagaccatcctgggcctcgacctggggaccaacagcatcggctgggccaagatctccatcgacgacaacgggaactacctgcgcgacatccagctcggcagccggatcatccccatgtcccaggacgtgctggggaacttcgacaacggcgtcacggagagccagaccgccgtgcgcaccggcttccgggggctgcgccggatccgcgagcggtccctcctgcgccgggagcgcctgcaccgggtgctccacgtcatgggcttcctgccgccccactacgacagcgcgatcgggtggaacaaggaggagcccaccacgtacggcaagttcctgaaccacggggagcccaagctcgcctgggagcgccagggcgacggctccatgcggttcctgttcatggacagcttccacaagatgatggaggacttcgccccgcaccagcccgccctggtggccgacgggcgcaagatccccctcgactggaccctgtactacctgcggaagaaggcgctcacccagcccatcaagaaggaggagctggcctggatcctgctcaacttcaaccagaagcgcggctactaccagctgcgcggggaggaggaggaggagaacccgaccaagcgggaggagtaccacgagctgaaggtggtcggcgtggaggccgccgaggagggcaagggcgggaacacgtggtacaacgtgaagctcgagaacgggtggatctaccggcgctccagcaagatccccctggacgactgggtcggcaagacccggcccttcatcgtgaccaccgagtacgaggcggacgggatcacgctgaagaagaacaaggagggcgaggtgaagcgctccttccgcgcccccggcgaggacgactgggggctctggaagaagcggaccgagagccagctggaggcctccggcaagaccgtcggggccttcatctacgaccacctcctggccgagccggcggacaagatccgcggcaacttcatccggaccatcgagcgcaagtactacaagcaggagctggccgacatcctgcgggagcagagcaagtaccacgaggagctccagtccaagaagatcctggccgactgcgccgaggagctgtaccgcagcaaccagccccaccgggactccctcctgaagaaggacatggtgtacctgctcctgacggacctgatcttctaccagcgccccctcaagagcaagaagtccctgatcgccgactgcccctacgagtactacgagtacgtggacaaggagaccggggagatcaagcggcagggcatcaagtgcatcgccaagagcaacccgtactaccaggagttccgcctgtggcagttcgtcctcaacctgcggctgtacgaccgcaccgaggacaaggaggtgaccgcggagtacctccccagcaaggaggactacgcccggctgttcgtgtacctgaacgaccgcaaggagatcaaccaggagacgctgctcaaggacttcttcaagctgaagaaggtcaagcagcggtccgagaaggacttccccgtgcgctggaactacatcgaggacaaggagaagaagtacccctgcaacgagacccggcacgagctgctcatggccctggaccgcgccggcatcgagcggagctggctggacgacaccgcgcgccagtaccgcctctggcacctcctgtactccatcgaggtgaaggacgaggccgagcgggccctgcgcaagctgaaggacgacgacgagttcgtcagcgccttcctgaaggtgaagccgttcaagaaggactacggggcctactccgagaaggcggtgaagaagctcctggccgtcatgcggatgggcagccactggtgcgaggacgacatctgcaaggagaccaaggagcgcatcgagcacatcctgcagggggacgtgggcgagaagatcaaggagcggatgaaccacacggcctactccctcggggagctgagcgacttccaggccctgcccgagtggctcgcgtgctacgtcgtgtacggccgccactccgaggccaccgacatcaagcactggaagacccccgagagcctgatggcctacatcaacggcttcaagcagcactccctgcggaaccccatcgtggagcagtgcatcctcgagaccctgcgcacggtccacgacatctggaaggaggccgggcacatcgacgagatccacgtggagctgggccggagcatgaagtccaccagcgaccagcgcgcccggatgaccgagaacatcctccgcaacgagaacaccaacctgcggatcaagtccctgctcatggagctgaagaacgacgcggacatcaaggacgtgcgcccgtacagccccatgcagcaggagatcctgcggatctacgaggagggggccctccaggagctgacgaaggaggacaacgactacgaggagatcttcaagatctccaagatgccccagcccagcgccaaggagctgctcaagtacaagctgtggctggagcagaagtaccgctccccgtacaccggcaagcccatcagcctcagcaagctgttcacctccgcctaccagatcgagcacatcatcccccagagccggtacttcgacgactccttcaacaacaaggtcatctgcgagagcgaggtgaacgccctgaagggcaacatgctcgggtacgagttcatcaagaaccacggcggggagatcgtgcactgcaccctgctgggcgacgtcaaggtgcagaacgagtccgagtacaaggcgttcgtgacggagcactacgccaacaacaagtacaagaaggagaagctcctgatggaggacatcccgcaggacttcctgaaccgccacctcaacgacagccggtacatctccaaggtcgtgaagaccctgctgagcaacatcgtgcgcaccgaggacgagatggagaccacctccaagttcgtcgtgagctgcaccgggggcatcacggaccggctcaagaaggactggggcctgaacgacgtgtggaactccatcgtctacagccgcttcgagcgcctgaacgagctcaccaagtccgacgccttcgggcggtgggagaacaaggagggcaagcgcgtgttccagaccagcgtgcccctggagctgcagcgggggttcaacaagaagcgcatcgaccaccggcaccacgccatggacgccctcgtcatcgcgtgcgcctcccgcaacatcatcaactacctgaacaacgagagcgccaactcccccaagaagcgggaggacctgcgccagcagctctgcgacaagaaccggatcatccgcaagccctgggagagcttcacgcaggacgcccgggcggccctggaggacgtggtggtcagcttcaagaactacgtgcgcgtgatcaacaaggccaccaactactacgagcggtacgacgccgacggcaagaagaccatcaccaagcagaagtcccgcgagatgtgggccgtccggaagccgatgcacaaggagacggtgttcgggcacgtgaacctgcgccggaaggcgatcgtcaagctcaaggacgccctggagaacatccccagcatctgcaacaaggagctgcgcgactacatcaacggcctcgtggagcggaacttcaacaccaagcagctgcacgcccacttccgctccaccgactaccgctggaacaagcagaacgtggacaaggtcgaggtgtggcggttcagcgacgagaaggagcccctggtggccacccgcaagcccctcgacacgtccttcgacgccaagcggatcgacaccatcaccgacaccggcatccagaagatcctgctgaactacctcgaggcgaagggcggggacccgctgatcgccttcacgcccgaggggatcgccgagatgaaccagaacatcgccctgtacaacgacggcaagatgcaccagcccatcctcaaggtccgcatcagcgagcccaagggggccaagtaccagatcggccagaccggcaacaaggcggacaagttcgtggaggcccagaaggggaccaacctgtacttcgccatctacgaggacgaggaccggaaccgcacctacaacacgatcccgctgaacgaggtggccgagcggctcaagcagggcctgccgcccgtccccgagaagaacgagaaggaggtgcccctgaagttctacctctcccccaacgacctggtgtacgtccccaccgaggaggagatcctgatgaaggagtgcaagctcaacaagaaccgcatctacaagatggtgagctccaccgggaaccagtgcttcttcatccccttccgggtggcggtcagcatcgtgaacaagatggagtactccccgctgaacaagatggagaaggccatcagctccgagatgatcaaggccgtgtgctggaagctggaggtcgaccgcctcggcaacatcatccgggtggtgaagtga

SEQ ID NO: 2242 - RNA, 4458 nt, synthetic construct
  misc_feature 1..4458: note = Cas9 variant
  source 1..4458: mol_type = other RNA
atgaagaacatcctgggcctcgacctggggaccaacagcatcggctgggccaagatctccatcgacgacaacgggaagtacatcaaggacagcatcaagctgggctcccgcatcatccccatgagccaggacgtgctctccaacttcagcaagggggtcaccctgtcccagacgagcgagcggacctccttccgcggcgcccggcgcctgcgggagcgcaccctcctgcggcgcgagcggctgcaccgcatcctccacctcctgggcttcctcccgaagcactacgagaaggcgatcgggtgggaccggaacgacaacaagacctacggcaagttcatcaaccacgccgagcccaagctggcctggtgcaaggacaacaacgggaagatgcgcttcctgttcatggacagcttccacgacatgctctccgagttcagcgagaagcaccccgagctgctggccaacggcaagaagatccccctcgactggacgatctactacctgcggaagaaggccctgtacaaggcgatcaccaaggaggagctcgcctggatcctgctgaacttcaaccagaagcgcgggtactaccagctccggggcgaggaggaccgcgactccgaggccaacaagaaggagtacctggagctgaaggtgatcggcgtggaggccaccggggagaagaagggcaacgacatctggtacaacatccacctcgagaacgggtggatctaccggcgcagctccaagaacccgctgaacgactggctgggcaaggtcaagagcttcatcgtgaccacggacctcgacgcggacggcaaccccaagaaggacaaggacgggaacatcaagcggtccttccgcgcccccagcgagggcgactggaccctgatcaagaagcggaccgagtccctgctcgagaacagcgggcagaccgtgggccagttcatctacaaccacatcctggaggagcccagcgccaagatccgcgggaacttcatccgcacgatcgagcggaagtactacaaggacgagctgaaggccatcctcgagaagcagaaggagttccaccacgagctgtccagcgagtccctgctcaccgagtgcgccaaggagctgtacaagcgcaacatcgcgcaccaggaggtcctgctcaagaagggcatgatccacctcctgctgaacgacatcctgttctaccagcggccgctgaagatcaagaagtccctcatcgacaactgcccctacgagaactacaagtacgtggacaagaagtccggcgacatcaaggtcaagagcatcaagtgcatcgccaagagcaaccccttcttccaggagttccgcctgtggcagttcgtgagcaacctgcggctgtaccgcaagtccgacgacaaggacgtgaccagcgagcacctcgtgaccacggacgactacgccaacctgttcacctacctgaacaaccggaaggacatcaagcagtccgtcctcctgaaggagtacttcaagatcaagaaggtgaagaccatcaacggggccgagtaccccgtgcgctggaactacatcgacgacgacaacaagacctacccgtgcaacgagacgcggtacgacatcctgcacgccctcagcaagaccgagctgaagtccgagtggctgacccccgagcgcacctaccggctctggcacctcctgtacagcatcgagtccaaggaggagacgaagaaggcgctgaacaagctgaacctgagcgacgacttcaccgaggccttcctcaccatcaagcccttcaagaaggagtacggctcctacagcgagaaggccatcaagaagctgctgtccctcatgcgcatggggtacctgtggagcgaggacgaggccatcaagcaggtcggcgccgagatcgagaagaccatcgagggggagctgcccgactacgtgctccagcggctggagaagtcccagcacaactacaacaagatcagcgacttcagcggcctgccgctctggctggcgtcctacatcatctacggccgccacagcgaggccaaggagatcatccactgggacaaccccgagtccatgatggcctacatcaaggacttccggcagcacagcatgcgcaaccccatcgtggagcagtgcgtcctggagacgctccggaccgtgcacgacatctggaaggagatcgggcacatcgacgagatccacatcgagctgggccgcgagatgaagtccaccagcgagcagcggaaggccatcacccagaacgtgctgcacaaccagaacacgaacatccgcatcaagctcctgctgcaggagctcaagaacgacaacaacatcaccggggtccgcccctactccccgatgcagcaggagatcctgcggatctacgaggagggcgccctgcaggggctcaccaaggaggacaaggactacaacgacatcctgaagatcagccagaccgcgcagcccacgtccaacgagctgacccgctacaagctctggctggagcagaagtaccggagcccctacaccggcaaggccatctccctgagcaagctgttcacctccgcctaccagatcgagcacgtgatcccccagagccgctacttcgacgactccctgagcaacaaggtgatctgcgagagcgaggtcaacaccctgaagaaggccatgctcggcatggagttcatcaagacgtgcgggggccagaaggtgcactgcaccctgctgggggacgtcgagatctacaacgaggaggactacaaggcgttcgtgaacgagcactactccaacaaccggaccaagcgcaacaagctcctgatggaggacatcccgcaggagttcatcaaccggcagctgaacgacagccgctacatctccaagatggtgaagcagctcctgagcgccatcgtccggggccaggaggaggtggaggccacctccaagttcgtgatcccctgcacgggcgggatcaccgaccgcctgaagaaggactggggcctcaacgacatctggaacaacctggtcagcccccggttccagcgcatgaacgccctgaccgggtccgagtacttcggccactgggagaacaaggaggggaagcgggtgttccagaccacgatgcccatccagctccagcagggcttcagcaagaagcgcatcgaccaccggcaccacgccatggacgcgctggtgatcgcctgcgcctcccgcaacatcatcagctacctgaacaacgagaccgcccaggacaccgagcggcgccgggacctccgccagaagctgtgcgacaagggcgggtccgtccggaagccgtgggacagcttcacccaggacacgcagtacgccctgaaggacatcatcgtgaccttcaagaactacgtgcgcatcatcaacaaggcgaccaactactacgagcactacaagaccgacggcaagaaggggatgatctcccagaagggcgacgagctctgggccatccgcaagcccatgcacaaggagacggtcttcgggaaggtgaacctgcggcgccccaagcgggtgagcctgtccaaggccatcgacagcgtcgacgtgatctgcaaccgcaagctcaagaagtacatcaaggcccggctgaacgagggcctgcagaagaagcagatcctcaacatcttcaaggaggtgaacaacgtctgggagggcatcgacgtgaacaagatcgacatctgggagatgtccaacgacaaggagccgatggtggccacccgcaagcagctggacaccagcttcgacgagaagaagatccggtccatcagcgacaccgggatccagaagatcctgctcaactacctgatcacgaagaacaacaaccccgagctggcgttcacccccgagggcatccaggagatgaacagcaacatctccgagtacaacgaccacaagaagcaccagcccatctacaaggtccgcgtgaccgagccgctcggggccaagtaccccatcggcaccatggggaacaaccccaagaagttcgtggaggcccaggccggcacgaacctgtacttcgcgatctacgaggacaaggagggcaaccggaactacgacaccatccccctgaacatcgccgccgagcgcctcaaccagcagctgagcccggtccccgagaccaacgagaacaacacgcccctgaagttctacctctcccccaacgacctggtgtacgtgccgagcgaggaggagcggcactccgggaacaacatccagctggacaagaaccgcatctacaagatggtcagctccaccagcaagcagtgcttcttcatccaccaccgggtggccatctccctcgtggacaagaaggagttcagcgcccagaacaagatggagcgctccatcgacaacgagcaggtcatgatcaagagcgtgtgctggaagctgatcaccgaccggctgggcaacatcatcaaggtgatcaagtga

SEQ ID NO: 2243 - RNA, 4458 nt, synthetic construct
  misc_feature 1..4458: note = Cas9 variant
  source 1..4458: mol_type = other RNA
atgaagaacatcctgggcctcgacctggggaccaacagcatcggctgggccaagatctccatcgacgacaacgggaagtacatcaaggacagcatcaagctgggctcccgcatcatccccatgagccaggacgtgctctccaacttcagcaagggggtcaccctgtcccagacgagcgagcggacctccttccgcggcgcccggcgcctgcgggagcgcaccctcctgcggcgcgagcggctgcaccgcatcctccacctcctgggcttcctcccgaagcactacgagaaggcgatcgggtgggaccggaacgacaacaagacctacggcaagttcatcaaccacgccgagcccaagctggcctggtgcaaggacaacaacgggaagatgcgcttcctgttcatggacagcttccacgacatgctctccgagttcagcgagaagcaccccgagctgctggccaacggcaagaagatccccctcgactggacgatctactacctgcggaagaaggccctgtacaaggcgatcaccaaggaggagctcgcctggatcctgctgaacttcaaccagaagcgcgggtactaccagctccggggcgaggaggaccgcgactccgaggccaacaagaaggagtacctggagctgaaggtgatcggcgtggaggccaccggggagaagaagggcaacgacatctggtacaacatccacctcgagaacgggtggatctaccggcgcagctccaagaacccgctgaacgactggctgggcaaggtcaagagcttcatcgtgaccacggacctcgacgcggacggcaaccccaagaaggacaaggacgggaacatcaagcggtccttccgcgcccccagcgagggcgactggaccctgatcaagaagcggaccgagtccctgctcgagaacagcgggcagaccgtgggccagttcatctacaaccacatcctggaggagcccagcgccaagatccgcgggaacttcatccgcacgatcgagcggaagtactacaaggacgagctgaaggccatcctcgagaagcagaaggagttccaccacgagctgtccagcgagtccctgctcaccgagtgcgccaaggagctgtacaagcgcaacatcgcgcaccaggaggtcctgctcaagaagggcatcatccacctcctgctgaacgacatcctgttctaccagcggccgctgaagatcaagaagtccctcatcgacaactgcccctacgagaactacaagtacgtggacaagaagtccggcgacatcaaggtcaagagcatcaagtgcatcgccaagagcaaccccttcttccaggagttccgcctgtggcagttcgtgagcaacctgcggctgtaccgcaagtccgacgacaaggacgtgaccagcgagcacctcgtgaccacggacgactacgccaacctgttcacctacctgaacaaccggaaggacatcaagcagtccgtcctcctgaaggagtacttcaagatcaagaaggtgaagaccatcaacggggccgagtaccccgtgcgctggaactacatcgacgacgacaacaagacctacccgtgcaacgagacgcggtacgacatcctgcacgccctcagcaagaccgagctgaagtccgagtggctgacccccgagcgcacctaccggctctggcacctcctgtacagcatcgagtccaaggaggagacgaagaaggcgctgaacaagctgaacctgagcgacgacttcaccgaggccttcctcaccatcaagcccttcaagaaggagtacggctcctacagcgagaaggccatcaagaagctgctgtccctcatgcgcatggggtacctgtggagcgaggacgaggccatcaagcaggtcggcgccgagatcgagaagaccatcgagggggagctgcccgactacgtgctccagcggctggagaagtcccagcacaactacaacaagatcagcgacttcagcggcctgccgctctggctggcgtcctacatcatctacggccgccacagcgaggccaaggagatcatccactgggacaaccccgagtccatgatggcctacatcaaggacttccggcagcacagcatgcgcaaccccatcgtggagcagtgcgtcctggagacgctccggaccgtgcacgacatctggaaggagatcgggcacatcgacgagatccacatcgagctgggccgcgagatgaagtccaccagcgagcagcggaaggccatcacccagaacgtgctgcacaaccagaacacgaacatccgcatcaagctcctgctgcaggagctcaagaacgacaacaacatcaccggggtccgcccctactccccgatgcagcaggagatcctgcggatctacgaggagggcgccctgcaggggctcaccaaggaggacaaggactacaacgacatcctgaagatcagccagaccgcgcagcccacgtccaacgagctgacccgctacaagctctggctggagcagaagtaccggagcccctacaccggcaaggccatctccctgagcaagctgttcacctccgcctaccagatcgagcacgtgatcccccagagccgctacttcgacgactccctgagcaacaaggtgatctgcgagagcgaggtcaacaccctgaagaaggccatgctcggcatggagttcatcaagacgtgcgggggccagaaggtgcactgcaccctgctgggggacgtcgagatctacaacgaggaggactacaaggcgttcgtgaacgagcactactccaacaaccggaccaagcgcaacaagctcctgatggaggacatcccgcaggagttcatcaaccggcagctgaacgacagccgctacatctccaagatggtgaagcagctcctgagcgccatcgtccggggccaggaggaggtggaggccacctccaagttcgtgatcccctgcacgggcgggatcaccgaccgcctgaagaaggactggggcctcaacgacatctggaacaacctggtcagcccccggttccagcgcatgaacgccctgaccgggtccgagtacttcggccactgggagaacaaggaggggaagcgggtgttccagaccacgatgcccatccagctccagcagggcttcagcaagaagcgcatcgaccaccggcaccacgccatggacgcgctggtgatcgcctgcgcctcccgcaacatcatcagctacctgaacaacgagaccgcccaggacaccgagcggcgccgggacctccgccagaagctgtgcgacaagggcgggtccgtccggaagccgtgggacagcttcacccaggacacgcagtacgccctgaaggacatcatcgtgaccttcaagaactacgtgcgcatcatcaacaaggcgaccaactactacgagcactacaagaccgacggcaagaaggggatgatctcccagaagggcgacgagctctgggccatccgcaagcccatgcacaaggagacggtcttcgggaaggtgaacctgcggcgccccaagcgggtgagcctgtccaaggccatcgacagcgtcgacatcatctgcaaccgcaagctcaagaagtacatcaaggcccggctgaacgagggcctgcagaagaagcagatcctcaacatcttcaaggagctgaacaacgtgtgggagggcatcgacgtgaacaagatcgacatctgggagatgtccaacgacaaggagccgatggtcgccacccgcaagcagctggacaccagcttcgacgagaagaagatccggtccatcagcgacaccgggatccagaagatcctcctgaactacctgatcacgaagaacaacaaccccgagctcgcgttcacccccgagggcatccaggagatgaacagcaacatctccgagtacaacgaccacaagaagcaccagcccatctacaaggtgcgcgtgaccgagccgctgggggccaagtaccccatcggcaccatggggaacaaccccaagaagttcgtcgaggcccaggccggcacgaacctgtacttcgcgatctacgaggacaaggagggcaagcggaactacgacaccatccccctcaacatcgccgccgagcgcctgaaccagcagctgagcccggtgcccgagaccaacgagaacaacacgcccctcaagttctacctgtcccccaacgacctggtgtacgtcccgagcgaggaggagcggcactccgggaacaacatccagctcgacaagaaccgcatctacaagatggtgagctccaccagcaagcggtgcttcttcatccaccaccgcgtggccatctccctggtcgacaagaaggagttcagcgcccagaacaagatggagcggtccatcgacaacgagcaggtcatgatcaagagcgtgtgctggaagctgatcaccgaccgcctcggcaacatcatcaaggtgatcaagtga

SEQ ID NO: 2244 - RNA, 4458 nt, synthetic construct
  misc_feature 1..4458: note = Cas9 variant
  source 1..4458: mol_type = other RNA
atgaagaacatcctgggcctcgacctggggaccaacagcatcggctgggccaagatctccatcgacgacaacgggaagtacatcaaggacagcatcaagctgggctcccgcatcatccccatgagccaggacgtgctctccaacttcagcaagggggtcaccctgtcccagacgagcgagcggacctccttccgcggcgcccggcgcctgcgggagcgcaccctcctgcggcgcgagcggctgcaccgcatcctccacctcctgggcttcctcccgaagcactacgagaaggcgatcgggtgggaccggaacgacaacaagacctacggcaagttcatcaaccacgccgagcccaagctggcctggtgcaaggacaacaacgggaagatgcgcttcctgttcatggacagcttccacgacatgctctccgagttcagcgagaagcaccccgagctgctggccaacggcaagaagatccccctcgactggacgatctactacctgcggaagaaggccctgtacaaggcgatcaccaaggaggagctcgcctggatcctgctgaacttcaaccagaagcgcgggtactaccagctccggggcgaggaggaccgcgactccgaggccaacaagaaggagtacctggagctgaaggtgatcggcgtggaggccaccggggagaagaagggcaacgacatctggtacaacatccacctcgagaacgggtggatctaccggcgcagctccaagaacccgctgaacgactggctgggcaaggtcaagagcttcatcgtgaccacggacctcgacgcggacggcaaccccaagaaggacaaggacgggaacatcaagcggtccttccgcgcccccagcgagggcgactggaccctgatcaagaagcggaccgagtccctgctcgagaacagcgggcagaccgtgggccagttcatctacaaccacatcctggaggagcccagcgccaagatccgcgggaacttcatccgcacgatcgagcggaagtactacaaggacgagctgaaggccatcctcgagaagcagaaggagttccaccacgagctgtccagcgagtccctgctcaccgagtgcgccaaggagctgtacaagcgcaacatcgcgcaccaggaggtcctgctcaagaagggcatgatccacctcctgctgaacgacatcctgttctaccagcggccgctgaagatcaagaagtccctcatcgacaactgcccctacgagaactacaagtacgtggacaagaagtccggcgacatcaaggtcaagagcatcaagtgcatcgccaagagcaaccccttcttccaggagttccgcctgtggcagttcgtgagcaacctgcggctgtaccgcaagtccgacgacaaggacgtgaccagcgagcacctcgtgaccacggacgactacgccaacctgttcacctacctgaacaaccggaaggacatcaagcagtccgtcctcctgaaggagtacttcaagatcaagaaggtgaagaccatcaacggggccgagtaccccgtgcgctggaactacatcgacgacgacaacaagacctacccgtgcaacgagacgcggtacgacatcctgcacgccctcagcaagaccgagctgaagtccgagtggctgacccccgagcgcacctaccggctctggcacctcctgtacagcatcgagtccaaggaggagacgaagaaggcgctgaacaagctgaacctgagcgacgacttcaccgaggccttcctcaccatcaagcccttcaagaaggagtacggctcctacagcgagaaggccatcaagaagctgctgtccctcatgcgcatggggtacctgtggagcgaggacgaggccatcaagcaggtcggcgccgagatcgagaagaccatcgagggggagctgcccgactacgtgctccagcggctggagaagtcccagcacaactacaacaagatcagcgacttcagcggcctgccgctctggctggcgtcctacatcatctacggccgccacagcgaggccaaggagatcatccactgggacaaccccgagtccatgatggcctacatcaaggacttccggcagcacagcatgcgcaaccccatcgtggagcagtgcgtcctggagacgctccggaccgtgcacgacatctggaaggagatcgggcacatcgacgagatccacatcgagctgggccgcgagatgaagtccaccagcgagcagcggaaggccatcacccagaacgtgctgcacaaccagaacacgaacatccgcatcaagctcctgctgcaggagctcaagaacgacaacaacatcaccggggtccgcccctactccccgatgcagcaggagatcctgcggatctacgaggagggcgccctgcaggggctcaccaaggaggacaaggactacaacgacatcctgaagatcagccagaccgcgcagcccacgtccaacgagctgacccgctacaagctctggctggagcagaagtaccggagcccctacaccggcaaggccatctccctgagcaagctgttcacctccgcctaccagatcgagcacgtgatcccccagagccgctacttcgacgactccctgagcaacaaggtgatctgcgagagcgaggtcaacaccctgaagaaggccatgctcggcatggagttcatcaagacgtgcgggggccagaaggtgcactgcaccctgctgggggacgtcgagatctacaacgaggaggactacaaggcgttcgtgaacgagcactactccaacaaccggaccaagcgcaacaagctcctgatggaggacatcccgcaggagttcatcaaccggcagctgaacgacagccgctacatctccaagatggtgaagcagctcctgagcgccatcgtccggggccaggaggaggtggaggccacctccaagttcgtgatcccctgcacgggcgggatcaccgaccgcctgaagaaggactggggcctcaacgacatctggaacaacctggtcagcccccggttccagcgcatgaacgccctgaccgggtccgagtacttcggccactgggagaacaaggaggggaagcgggtgttccagaccacgatgcccatccagctccagcagggcttcagcaagaagcgcatcgaccaccggcaccacgccatggacgcgctggtgatcgcctgcgcctcccgcaacatcatcagctacctgaacaacgagaccgcccaggacaccgagcggcgccgggacctccgccagaagctgtgcgacaagggcgggtccgtccggaagccgtgggacagcttcacccaggacacgcagtacgccctgaaggacatcatcgtgaccttcaagaactacgtgcgcatcatcaacaaggcgaccaactactacgagcactacaagaccgacggcaagaaggggatgatctcccagaagggcgacgagctctgggccatccgcaagcccatgcacaaggagacggtcttcgggaaggtgaacctgcggcgccccaagcgggtgagcctgtccaaggccatcgacagcgtcgacgtgatctgcaaccgcaagctcaagaagtacatcaaggcccggctgaacgagggcctgcagaagaagcagatcctcaacatcttcaaggagctgaacaacgtgtgggagggcatcgacgtcaacaagatcgacatctgggagatgtccaacgacaaggagccgatggtggccacccgcaagcagctggacaccagcttcgacgagaagaagatccggtccatcagcgacaccgggatccagaagatcctcctgaactacctgatcacgaagaacaacaaccccgagctcgcgttcacccccgagggcatccaggagatgaacagcaacatctccgagtacaacgaccacaaggagcaccagcccatctacaaggtgcgcgtcaccgagccgctgggggccaagtaccccatcggcaccatggggaacaagcccaagaagttcgtggaggcccaggccggcacgaacctgtacttcgcgatctacgaggacaaggagggcaaccggaactacgacaccatccccctcaacatcgccgccgagcgcctgaaccagcagctgagcccggtgcccgagaccaacgagaacaacacgcccctcaagttctacctgtcccccaacgacctggtctacgtgccgagcgaggaggagcggcactccgggaacaacatccagctcgacaagaaccgcatctacaagatggtgagctccaccagcaagcagtgcttcttcatccaccaccgggtcgccatctccctggtggacaagaaggagttcagcgcccagaacaagatggagcgctccatcgacaacgagcaggtcatgatcaagagcgtgtgctggaagctgatcaccgaccggctcggcaacatcatcaaggtgatcaagtga

SEQ ID NO: 2245 - RNA, 4461 nt, synthetic construct
  misc_feature 1..4461: note = Cas9 variant
  source 1..4461: mol_type = other RNA
atgaccaagatcctgggcctcgacctggggaccaacagcatcggctgggccatccgcgaggacgagaacgagggggtgaaccagatcatcgacaagggcgtccggatcttctccgagggggtcaagagcgagaacggcaaggagatctcccgcgccgcggagcggacggcctaccgcagcgcccggaagatcaagtaccgccggaagctgcgcaagtacgagaccctcaaggtgctgtccgtgaacggcatgtgccccctgagcgtggaggaggtggagcagtggaagaagtccgggttcaaggagtacccgctcaaccccgagttcctgaactggctgcggaccaacgaggacaagaacatcaacccctacttcttccgcgacaaggccagcaagcagaaggtcaccctcttcgagctgggccgggccctgtaccacatcgcgcagcgccgggggttcctctccaaccgcctggaccagagcgccgagggcgtgttcgaggagcacaacccccagatccagaacctgatcgaggacctcgactccagcaacacgatcctgaacgagctgaaggagtactacatcaacctcgggatcatcgacgagtccgagaagtccggcttcaagaaggacctggacgagggcgagaagaacctgaagaagctctacacctccctggtgagcatcaccaagaagaacgccaacgacatcgagacctgcaagcaggagctgatcgcccggctcaacaagaaggaggacctggggaaggtcaagggcgagatcaaggacatctcccaggcgatgctggacgggaacttcaagacgctcggccagtacttcttcagcctgtacaacaagacccgcatccggaaccagtacacctcccgcgaggagcactacctggaggagttcatcatcatctgccagacccagggcatcgaggagatcaacacgaacgagaagctcccggagaagaagttcaccgggctggccaaggacctgtaccgggccatcttcttccagcgccccctcaagagccagaagggcctgatcgggaagtgcagcttcgagaagaacaagtcccggtgcgccgtgagccaccccgactacgaggagttccgcatgtggtcctacctgaacaccatcaagatcggcacccagagcgagaagacgctccgcttcctgaccctggaggagaagctcaagctggtgcccaagttctaccggaagaacgacttcaacttcgaggtcctggccaaggagctcgtggagaagggggcgtccttcggctactacaagagctccaagaagaacgagttcttctactggttcaactacaagccgaccgacagcgtgtccgcctgcgtcgtgagcgcctccctggagaacgccatcggcaaggactggaagaccaagacgttcgagtaccagaccagcaacaccaagaaggaggaggtgaccaagtccgtcaactacaaggacctgtggcacctcctgagcgtggccacgtccgacacctacctgtacgacttcgcgatcgagaagctcaagctggagcccaagaacgccaaggccttcagcaagaccaagctgaagaaggacttcgcctccctgagcctcgccgcgatcgccaagatcctgccctacctgaagcaggggctcctgtactcccacgccgtgttcatcgccaacatcgagaacatcgtcgacgccgacatctggaaggacaaggagcagcagaagttcatccagagcaagatcgtggacctgatcgacaactacctcgtggagaagtccaagctggagatcatcaactgcctgctcaagatctacaacaccgaggacatcgagggccgcaaggtctactacagcaaggaggcggagagcctgttcgaggccgacctgcggaagaagctcgtgcccttctacaaggccaacacgatctccgagcagcaggagcaggagatcatcttcaaggacctgttcccggtcctgatcgagcagctcaagaagcaggagttcatcaagatcgtgcgcctggacaagaagatcgaggccttcctgaagggggagaacgaggagggccagatcttctgcaactaccccgagaagttcaagaagctctaccaccccagcgacatcgaggtgttcaagaagaagatcatcaaggacgagtgggggaacgagaaggtcgtgctgggcagccccctgaccaccagcatcaagaacccgatggcgatgcgggccctccaccagctgcgcaaggtgctgaacaccctcatcctggacggccagatcgacgagaagacgcggatccacatcgagatggcccgcgagctgaacgacgccaacaagcggaaggggatccaggacttccagaaggagcgcgaggagctctacaagatctacgaggccaagatcaaggagctgtaccaggtcaagaccggcaaggagctgctccacgtgaccgacgaggacctgcagaagttcgagtgggcgctggagcagaccaaggacgggcggatcatcacgaaggaggagctcatcaagtacaagatctgggaggagcagaaccacatctgcatctacaccggcaagaccatctccatcgacagcttcctcgggggcaaccccaagttcgacatcgagcacaccatcccccgctccatcagccaggacaactccctgatgaacaagaccctgtgcgacaaggacttcaaccggagcgtgaagggcaagaagatgcccgtcgagctgtccaactacaacgagatcctgccgcgcatcgcccactggaagaagcaggccgaggagctcacgcggcagatcgagaccatcagccgctccatcaagagcgccgccaccaaggtggcgaaggacaagaacatccggaagcgccactacctgaccctgaagcgggactacatccaggggaagtacgaccgcttcacgtggggcgagcccaaggtggggttcaagaactcccagatccccgacaccggcatcatcaccaagtacgcccaggcctacctcaagagctacttcaagcgcgtcgagagcgtgaagggcggggccgtggccgagttccggaagctgtggggcatccaggagtccttcatcgacgagaacgggttcaagcacttcaaggagaaggaccgcagcaagcacacccaccacacgatcgacgcgatcaccatcgcctgcatgcccaaggacaagtacgacctgctcgcccacgcctggcggctggaggacgagcagaacaagaaggcggccaaggccctgatcgagcaggccaagccgtggaagaccttcaaggaggacatcgagaagatcgaggccgagatcctcgtctcccacttcacccccgacaacgtgaagaagcaggcgaagaagatcctgcgcgtgcggggcaagaagcagtacgtcgccgagatcgagcgcaacgccaacgggaaggccatccccaagaaggacgccagcggcaagatcatctacaagctgaacgagcggggcaacaagatccccatcctccagcagggggacacgatccgcggctccctgcaccaggacagcatctacggggcgatcaagaacccgctgaacaccaacgagatccggtacgtgatccgcaaggacctcgagtccctgaaggccaacgacatcgagaacatcgtggacgagaacgtcaaggccaaggtgaaggaggccgtggccaacaagatcctgctcatcagctccaacccccagcagaagaacaagttcgcggagggcaagaacgtctggatgaacgaggagaagaagatccccatcaacaaggtgcggatctacgccaacagcgtgaagaacccgatcgagatcaagaagcactccaccctgagcaagtccaagcacgagcacaagcagaccgtctacgggcagaacgacgagaactacgccatggccctgtacgagctcgacggcaagcgcgagttcgagctgatcaacaacttcaacctggcgaagctcctgaagcagggccaggggtactaccccctgcacaaggagaaggagatcaagggcaagaaggtgctcatccccatcgagaagcggaacaaccgcgacgtggtcctgaagcgggggcagcaggtcgtgttctacgacaagacggtggagaacagcaaggacatctccgagatcgtggacttccgcggccgggtgtacctgatcgaggggctcaccatccagcgccagaaggacaagaagaccggcaaggtcaacgagtacggcatcatccagctgcggtacttcaaggaggcccgcaagagcgaggagatctccaaggacagcttcaagcccgacggggagttcaagatcaacgagaacaagccgacccggaagatgaaccacaaccagttcacggccttcgtggagggcatcgacttcaaggtgctgccctccgggaagttccagaagatctga

SEQ ID NO: 2246 - RNA, 4464 nt, synthetic construct
  misc_feature 1..4464: note = Cas9 variant
  source 1..4464: mol_type = other RNA
atgaagaacgtgctgggcctcgacctggggagcaactccgtcggctgggccctggtgaagaccgaggacaacgggaaccccatcggcagcatcaagatggggtcccgcatcatcccgatgagccaggacatcctcggctccttcgagaagggcgacaccgtgagccagacggcccagcggaccctgtaccgcgggaagcggcgcctgatcgagcggcacgtcctccgccgggagcgcctgtgccgggtgctgcacatcatgaacttcctccccgaccacttcgacaagctgctgggctgggacaagaccgacaacaagacctacgggaagttcatcgacgactccgagcccaagctcgcgtggcgccagaacaagaacgagaaggagaagatggagttcgtgttcatggacagcttccacgagatgctgtccgacttcgccaagcaccagccccagctgatcgccaacggcaagaaggtcccgctcgactggacgatctactacctgcggaagaaggccctgacccagctcatcagcaaggaggagctggcctggatcctgctcaacttcaacaagaagcgcgggtactaccagctgcggggcgaggaggaggaggagcagcccaccaagaaggaggagtacaaggtgctgaaggtgatctccgtcgacgcggacgagggccagaaggggaacggcatctggtacaacatccacctcgaggacgggggcatctacaagcgcaagagcgacacgcccctgtacgactgggtgggcaagaccctgcagctcatcgtggtcaccatctacgagaaggacgggaagacccccaagatcttcgactccggcaagcagaacccgagctaccggctgcccaaggaggacgactgggggctgatcaagaagcgcaccgagtcccagatccagagctccggcaagacggtgggggccttcatctacgacaacatcctcagcaagcccgacgacaagatccggggcaacctggtgcgcaccatcgagcggaagtactacaagaaggagctgatcgagatcctccagcagcaggccaagtaccacgacgagctgcacaaccagaacctgctcgagtcctgcgccaaggagctgtacgcgcacaacgacgtccgctacaacgaggtggtcaagagcaacatgatccacctcctggtggacgacatcatcttctaccagcggcccctcaagagcaagaagtccctgatcgccaactgcaagtacgagagctacgagtacgtggacaaggagaccggcgaggtgaaggagatgccgatcaagtgcatcgccaagtccaacccctactaccaggagttccgcctgtggcagttcatccacaacctgcgcctgagcgacgtcgtgacccgggaggacgtgacggcccagtacctctccacgccccaggactactgcaacctgttcacctacctgaacgaccgcaaggagatcaagcaggacatcctcctgaaggacttcttcaagatcaagaaggtccagatcgacaaggagaaggtgttccccatcgagtggaactacatcaaggacgccaccaagacctacccgtgcaacgagacccggtacgagctgctgagcgcgctcaagcgcgccgggatggacaagcagtggctggacgacacccccaacatgcagtaccggctgtggcacctcctgtactccgtcgaggagcaggaggagagcgccaaggccctgcgcaagctctacgacaacgacaacttcgtgtccagcttcctgaagatcaagcccttcaagaagtgctacggcgcctactccgagaaggcgatcaagcggctgctcaccctgatgcgcatggggaaggcctgggacgagcaggccatcgacgccaagacgctgaagtgcatccagcagatcatcaccggcaacatcgacagcaagctcaaggagaagatcgacgactcccggtacgtgctgcaccacgtcagcgacttccaggggctgcccacctacctcgcctcctacgtgatctacggccgccacagcgaggtgaccgacatccggtgctgggacacgccgaaggacctgctgaagttcatctgcggcttcccccagcactccctccgcaaccccatcgtcgagcaggtcatcctggagaccctgcgggtggtgtacgacatctggaaggcggagaagcacatcgacgagatccacgtggaggtggcccgcgagatgaagctcaccgcccagcagcggaacgaggccaacctgcgcaacctgaacaacgaggccaccaacctccggatcaagtacctgctggaggagctcaagaacgacacgttcatcaaggacgtccgccccctgagcccgatgcaccaggagaagatgcggatctacgagcaggcggtgctggggaacctcaacaagcaggacaaggactacgacgacatcatcaagatctccaagaaggagcgccccaccagcgccgagctgatccgctacaagctgtggctcgagcagaagtactgcagcccctacaccggcaaggccatctccctgagcaagctgttcaccacggcctaccagatcgagcacgtgatcccccagtcccggtacttcgacaacagcttcaacaacaaggtcatctgcgagtccgaggtgaacaaggagaaggacaagatgctcgggtacgagttcatcaagggccgcgggggcgaccggatctactgcaccgcgcacggcaaggaggtgaccatcctgaaggaggaggagtacaagcagttcgtcaacgagcactacgcccacaacaagcgcaagcgggacaacctgctcgccgagaacatcccggagagcttctccagccgccagctgaacgacacccggtacatcaccaagacgatcatgtccctgctcagcaacgtggtgcgccagcagggggaggaggaggccaccgccaagaacctgctgccctccagcggcgcggtcaccgacaagctcaagaacgactgggggctgaaggacgtgtggaacaccatcgtgacgccccggttcgagcgcctgaacaagctctccggcaccaacgacttcggcgagatgaaggaggagaacgggaaccggtacttccagaccaacgtcccgagcgagtacgagaagggcttcaagaagaagcgcatcgaccaccggcaccacgccatggacgccctggtgatcgcctgcaccacgcgcaacatggtgaactacatctccaacgtcaacgccaacagccccaagcagcgggaggacctgcgccagctcctgtgcgacaagaaccggatcatcaacaagccctggaacaccttcacccaggacgcgctgaaggccctcaacgacatcgtggtgtccttcaagaacaacgtccgcatcatcaaccgggccaccaaccgctaccagcggtacgacaagaacgggaagaagatgatctgcagccagaagggcaacgacatgtgggccatccgcaagagcatgcacaaggagacggtgttcgggcgcgtgaacctgatccggaaggaggccctgcccatcgcgaaggccctcgacaacatctccgccatctgcaacgcccagctgcgcgcgtacgtcaacgacctggtggacaagcacttcaacaagaagcagctcgtggcccacttcaagagcctggactacaagtggaaccggcaggacgtctccaaggtggaggtgtggatcagctccgacgacaagaccccgatggtcgccgtgcgcaagcccctggacaccagcttcgacaagaagaagatcgcctccatcaccgacacgggcatccaggccatcctcctgaactacctggagagcaagggcggggacgcgctcgtggccttcgcccccgagggcatccaggagatgaactccaacatcgagctgtacaacaacgggaaggcccacaagcccatcaagaacgtccggctgagcgagaccctcggcgccaagtaccaggtgggggagcgcggcgcgaagaccaagaagtacgtggtcgccgacaagggcaccaacctgttcttcgccatctacgaggacgaggaggggaagcggtactactactccgtgccgctgcgcgaggccatcgagcggcagaagcagaagctcagccccgtgcccgagtacaacgagaagggcgtcgccctgaagttctacctgtcccccaacgacctcgtgtacgtgccgacggaggaggagcgcaccatggggacctgccacatcgacaagacccggatctacaagatggtcagctccagcgagaaccgctgctgcttcgtgccctccacgatcgcgaaggtcatcgccgacaaggtggagctgctgagccacaacaagatcgagaaggccatcaccggcgagtccatcaaggaggtgtgctggaagctcaaggtcgaccggctggggaacatcctgaacgtgatcaagtga

SEQ ID NO: 2247 - RNA, 4464 nt, synthetic construct
  misc_feature 1..4464: note = Cas9 variant
  source 1..4464: mol_type = other RNA
atgaagaacgtgctgggcctcgacctggggagcaactccgtcggctgggccctggtgaagaccgaggacaacgggaaccccatcggcagcatcaagatggggtcccgcatcatcccgatgagccaggacatcctcggctccttcgagaagggcgacaccgtgagccagacggcccagcggaccctgtaccgcgggaagcggcgcctgaccgagcggcacgtcctccgccgggagcgcctgtgccgggtgctgcacatcatgaacttcctccccgaccacttcgacaagctgctgggctgggacaagaccgacaacaagacgtacgggaagttcatcgacgactccgagcccaagctcgcgtggcgccagaacaagaacgagaaggagaagatggagttcgtgttcatggacagcttccacgagatgctgtccgacttcgccaagcaccagccccagctgatcgccaacggcaagaaggtcccgctcgactggaccatctactacctgcggaagaaggccctgacccagctcatcagcaaggaggagctggcctggatcctgctcaacttcaacaagaagcgcgggtactaccagctgcggggcgaggaggaggaggagcagcccaccaagaaggaggagtacaaggtgctgaaggtgatctccgtcgacgcggacgagggccagaaggggaacggcatctggtacaacatccacctcgaggacgggggcatctacaagcgcaagagcgacatccccctgtacgactgggtgggcaagacgctgcagctcatcgtggtcaccatctacgagaaggacgggaagacccccaagatcttcgactccggcaagcagaacccgagctaccggctgcccaaggaggacgactgggggctgatcaagaagcgcaccgagtcccagatccagagctccggcaagacggtgggggccttcatctacgacaacatcctcagcaagcccgccgacaagatccggggcaacctggtgcgcaccatcgagcggaagtactacaagaaggagctgatcgagatcctccagcagcaggccaagtaccacgacgagctgcacaaccagcacctcctggagtcctgcgcgaaggagctgtacgcccacaacgacgtccgctacaacgaggtggtcaagagcaacatgatccacctcctggtggacgacatcatcttctaccagcggcccctcaagagcaagaagtccctgatcgacaactgcaagtacgagagctacgagtacgtggacaaggagaccggcgaggtgaaggagatgccgatcaagtgcatcgccaagtccaacccctactaccaggagttccgcctgtggcagttcatccacaacctgcgcctgagcgacgtcgtgacccgggaggacgtgacggcccagtacctctccacgccccaggactactgcaacctgttcacctacctgaacgaccgcaaggagatcaagcaggacatcctcctgaaggacttcttccagatcaagaaggtccagatcgacaaggagaaggtgttccccatcgagtggaactacatcaaggacgccaccaagacctacccgtgcaacgagaccaagtacgagctgctgagcgcgctcaagcgggccgggatggacaagcagtggctggacgacacccccaacatgcagtaccgcctgtggcacctcctgtactccgtcgaggagaaggaggagagcgccaaggccctgcggaagctctacgacgacgacaacttcgtgtccagcttcctgaagatcaagcccttcgagaagtgctacggcgcctactccgagaaggcgatcaagcgcctgctcaccctgatgcggatggggaaggcctgggacgagcaggccatcgacgccaagacgctgaagtgcatccagcagatcatcaccggcaacatcgacagcaagctcaaggagaagatcgacgactcccgctacgtgctgcaccacgtcagcgacttccaggggctgcccacctacctcgcctcctacgtgatctacggccggcacagcgaggtgaccgacatccgctgctgggacacgccgaaggacctgctgaagttcatctgcggcttcccccagcactccctccggaaccccatcgtcgagcaggtcatcctggagaccctgcgcgtggtgtacgacatctggaaggcggagaagcacatcgacgagatccacgtggaggtggcccgggagatgaagctcaccgcccagcagcgcaacgaggccaacctgcggaacctgaacaacgaggccaccaacctccgcatcaagtacctgctggaggagctcaagaacgacacgttcatcaaggacgtccggcccctgagcccgatgcaccaggagaagatgcgcatctacgagcaggcggtgctggggaacctcaacaagcaggacaaggactacgacgacatcatcaagatctccaagaaggagcggcccaccagcgccgagctgatccgctacaagctgtggctcgagcagaagtactgcagcccctacaccggcaaggccatctccctgagcaagctgttcaccacggcctaccagatcgagcacgtgatcccccagtcccgctacttcgacaacagcttcaacaacaaggtcatctgcgagtccgaggtgaacaaggagaaggacaagatgctcgggtacgagttcatcaagggccgcgggggcgaccggatctactgcaccgcgcacggcaaggaggtgaccatcctgaaggaggaggagtacaagcagttcgtcaacgagcactacgcccacaacaagcggaagcgcgacaacctgctcgccgagaacatcccggagagcttctccagccggcagctgaacgacacccgctacatcaccaagacgatcatgtccctgctcagcaacgtggtgcggcagcagggggaggaggaggccaccgccaagaacctgctgccctccagcggcgcggtcaccgacaagctcaagaacgactgggggctgaaggacgtgtggaacaccatcgtgacgccccgcttcgagcggctgaacaagctctccggcaccaacgacttcggcgagatgaaggaggagaacgggaaccgctacttccagaccaacgtcccgagcgagtacgagaagggcttcaagaagaagcggatcgaccaccgccaccacgccatggacgccctggtgatcgcctgcaccacgcggaacatggtgaactacatctccaacgtcaacgccaacagccccaagcagcgcgaggacctgcggcagctcctgtgcgacaagaaccgcatcatcaacaagccctggaacaccttcacccaggacgcgctgaaggccctcaacgacatcgtggtgtccttcaagaacaacgtccggatcatcaaccgcgccaccaaccggtaccagcgctacgacaagaacgggaagaagatgatctgcagccagaagggcaacgacatgtgggccatccgcaagagcatgcacaaggagacggtgttcgggcgggtgaacctgatccgcaaggaggccctgcccatcgcgaaggccctcgacaacatctccgccatctgcaacgcccagctgcgggcgtacgtcaacgacctggtggacaagcacttcaacaagaagcagctcgtggcccacttcaagagcctggactacaagtggaaccgccaggacgtctccaaggtggaggtgtggatcagctccgacgacaagaccccgatggtcgccgtgcggaagcccctggacaccagcttcgacaagaagaagatcgcctccatcaccgacacgggcatccaggccatcctcctgaactacctggagagcaagggcggggacgcgctcgtggccttcgcccccgagggcatccaggagatgaactccaacatcgagctgtacaacaacgggaaggcccacaagcccatcaagaacgtccgcctgagcgagaccctcggcgccaagtaccaggtgggggagcggggcgcgaagaccaagaagtacgtggtcgccgacaagggcaccaacctgttcttcgccatctacgaggacgaggaggggaagcgctactactactccgtgccgctgcgggaggccatcgagcgccagaagcagaagctcagccccgtgcccgagtacaacgagaagggcgtcgccctgaagttctacctgtcccccaacgacctcgtgtacgtgccgacggaggaggagcggaccatggggacctgccacatcgacaagacccgcatctacaagatggtcagctccagcgagaaccggtgctgcttcgtgccctccacgatcgcgaaggtcatcgccgacaaggtggagctgctgagccacaacaagatcgagaaggccatcaccggcgagtccatcaaggaggtgtgctggaagctcaaggtcgaccgcctggggaacatcctgaacgtgatcaagtga

SEQ ID NO: 2248 - RNA, 4464 nt, synthetic construct
  misc_feature 1..4464: note = Cas9 variant
  source 1..4464: mol_type = other RNA
atgaagaacatcctgggcctcgacctggggagcaactccgtgggctgggccctggtcaaggtggaggagaacgggaaccccatcggcagcatcaagatggggtcccgcatcatcccgatgagccaggacatcctcggctccttcgagaagggcgacaccgtgagccagaccgcccagcggacgctgtaccgcgggaagcggcgcctgatcgagcggcacgtcctccgccgggagcgcctgtgccgggtgctgcacatcatgaacttcctccccgcgcacttcgaccgcctgctgggctgggacaagaccgacaacaagacctacgggaagttcatcgacgactccgagcccaagctcgcctggcggcagaacaagaacgagatgggcaagatggagttcgtgttcatggacagcttccacgagatgctgtccgacttcgccaagcaccagccccagctgatcgccaacgggaagaaggtcccgctcgactggaccatctactacctgcgcaagaaggccctgacgcagctcatcagcaaggaggagctggcgtggatcctgctcaacttcaacaagaagcggggctactaccagctgcgcggcgaggaggaggaggagcagcccaccaagaaggaggagtacaaggtgctgaaggtgatctccgtcgacgccgacgaggggcagaagggcaacgggatctggtacaacatccacctcgaggacggcggcatctacaagaagaagtccgacatccccctgtacgactgggtggggaagaccctgcagctcatcgtggtcaccacgtacgagaaggacggcaagacccccaagatcttcgacagcgggaagcagaacccgagctaccggctgcccaaggaggacgactggggcctggtgaagaagcgcaccgagtcccagctccagagctccgggaagaccgtgggcgccttcatctacgacaacatcctgagcaagcccgacgacaagatccggggcaacctggtccgcacgatcgagcggaagtactacaagaaggagctcatcgagatcctgcagcagcaggccaagtaccacgacgagctgcacaaccagaacctcctggagtcctgcgcgaaggagctgtacgcccacaacgacgtgcactacaacgaggtgatcaagagcaacatgatcaacctcctggtcaacgacatcatcttctaccagcgccccctcaagagcaagaagtccctcatcgccaactgcaagtacgagagctacgagtacgtggacaaggagaccggggagatcaaggagatgccgatcaagtgcatcgccaagtccaacccctactaccaggagttccggctgtggcagttcatccacaacctgcgcctcagcgacgtggtcacccgcgaggacgtgaccgcccagtacctgtccacgccccaggactactgcaacctgttcacctacctcaacgaccggaaggagatcaagcaggacatcctgctgaaggacttcttcaagatcaagaaggtgcagatcgacaaggagaaggtcttccccatcgagtggaactacatcaaggacgcgaccaagagctacccgtgcaacgagacccgctacgagctgctctccgccctgaagcgggccggcatggacaagcagtggctggacgacacgcccaacatgcagtaccgcctctggcacctcctgtacagcgtggaggagaaggaggagtccgccaaggccctgcggaagctgtacgacgacgacaagttcgtcaccagcttcctgaagatcaagcccttcaacaagtgctacggggcgtactccgagaaggccatcaagcgcctcctgaccctgatgcggatgggcaaggcctggaacgagcaggccatcgacgccaagaccctcaagtgcatccagcagatcatcacggacaacgtggacagcaagctgaaggagaagatcgacgactcccgctacgtgctgcaccacgtcagcgacttccaggggctccccacctacctggcgtcctacgtgatctacggccggcacagcgaggtgaccgacatccagtgctgggactccccggaggacctgctcaagttcatccgcgacttcaagcagcacagcctgcggaaccccatcgtcgagcaggtcatcctggagaccctccgcgtggtgtacgacatctggaaggccgagaagcacatcgacgagatccacgtggaggtggcccgggagatgaagctgacggcccagcagcgcaacgaggccaacctgcggaacctcaacaacgaggcgaccaacctgcgcatcaagtacctgctcgaggagctgaagaacgacaccttcatcaaggacgtccggcccctgtcccccatccaccaggagaagatgcgcatctacgagcaggccgtgctcggcaacctgaacaagcaggacaaggactacgacgacatcatcaagatcagcaagaaggagcacccgaccaacgccgagctgatccggtacaagctctggctggagcagcgctactgcagcccctacacggggaaggccatctccctgagcaagctgttcaccaccgcgtacgagatcgagcacatcatcccccagtcccgctacttcgacaacagcttcaacaacaaggtgatctgcgaggccgaggtcaacaaggccaagggcaacatgctggggtacgagttcatcaagaagcagggcgggcagaagatctactgcacccagctgggcaaggccgtgacgatcctcaaggaggaggcctacaagcagttcgtgaacgagcactacgcgcacaacaagcggaagcgcgacaacctgctggccgagaacatccccgagtccttcagctcccggcagctcaacgacacccgctacatcaccaagaccatcatgagcctgctgtccaacgtcgtgcggcagcagagcgaggaggaggccaccgccaagaacctcctgccgtccagcggctccgtgacggaccgcctgaagaacgactgggggctcaaggacgtctggaacaccatcgtgacgccccggttcgagcgcctgaacaagctgagcggcaccaacgacttcggggagatgaaggaggagaacggcaaccggtacttccagaccaacgtgcccctcgagtacgagaagggcttcaagaagaagcgcatcgaccaccggcaccacgccatggacgcgctggtcatcgcctgcaccacccgcaacatggtgaactacatctccaacgccaacgccaacagcccgaagcagcgggaggacctgcgccagctcctgtgcgacaagaaccggatcatcaacaagccctgggacaccttcacgcaggacgccctgaaggcgctcaacgacatcgtggtctccttcaagaacaacgtgcgcatcatcaaccgggccaccaaccgctaccagcggtacgacaagaacgggaagaagatcatcttcagccagaagggcgacgacatgtgggccatccgcaagagcatgcacaaggagaccgtgttcgggcgggtcaacctgatccgcaaggaggtgctgcccatcgccaaggcgctcgacaacatctccgccatctgcaacgcccagctgcgcgcctacgtgaacgacctggtcgacaagcacttcaacaagaagcagctcgtggcccacttcaagagcctgaactacaagtggaaccggcaggacgtgtccaaggtcgaggtgtggatcagctccgacaacaagacccccatggtggcggtccgcaagccgctggacacgagcttcgacaagaagaagatcgcctccatcaccgacaccggcatccagaccatcctcctgaactacctggagagcaagggcggggacgcctccgtggccttcgcccccgagggcatccaggagatgaacagcaacatcgagctctacaacaacgggaaggcgcacaagcccatcaagaacgtgcggctgtccgagcccctgggcgccaagtaccaggtcggggagcgcggcgccaagacgaagaagtacgtggaggccgacaaggggaccaacctcttcttcgccatctacgaggacgaggagggcaagcggtactactacagcgtgccgctgcgcgaggcgatcgagcggcagaagcagaagctgtcccccgtccccgagtacaacgagaagggcgtggccctcaagttctacctgagccccaacgacctggtgtacgtcccgaccgaggaggagcgcaccatggggacgtgccacatcgacaaggcccggatctacaagatggtgtccagcaccggctgctcctgctacttcgtgcccagcaccttcgccaaggtcatcgtggacaaggtcgagctccagtccctgaacaagatggagaaggcgatcaccgacgagtgcatcaaggaggtgtgctggaagctgaaggtggaccgcctcgggaacatcatcaacgtcatcaagtga

SEQ ID NO: 2249 - RNA, 4485 nt, synthetic construct
  misc_feature 1..4485: note = Cas9 variant
  source 1..4485: mol_type = other RNA
atgaagaacatcctgggcctcgacctggggaccaacagcatcggctgggccctgatcgacaacgagagccaccgcatcatcaagagcgggtcccggatcatccccatggacgccgcgaccatgggcgactacgagaaggggaacctcaagagcgccgactggaagcgcacgtccttccggggcatgcgccggctgtacgagcgcgccaagctgcggcgcgagcggctcctgcgcgtgctgaacatcctcggcttcctgccggaggagttccggcgccagatcgacttcgagcaccaccccgggcagttcatcgacggcaaggagcccctgatcgcctaccaccacgacgagaacgggcagcgggtcttcagctacatgtccgccttcgaggagatgctcaccgacttccgcgcgacccagagcgagctggtgcgggacggccgccgggtgccctacgactggaccatctactacctgcgccacaaggccctcacgcagccggtcaccaaggaggagctggcctggatcatcctgaacttcaacaccaagcgggggtactaccagctccgctccgagagcgaggaggtgaccacgaacaagaacgaggagtacgccgagctgaaggtggtctccgtggagaagaccggcgaggacaagaagcgggcgggctactactggtacaccatcacctacgacaacgaggccgagcagaagatcacgagcaccatcccgccccgccagatcggggacaaggtggagctgatcgtcaccaccgcccgcgacaaggccggcgagatcaagaagtccgtgcggagccccaaggaggacgactggacgctcatgaagaagcgcaccgagcacaacatcgaggaggaggagtgcaccgtggggtcctacatctaccagcacatcctggccgaccccaccgtcaaggtgcggggcaagctggtgcacacgatcgagcgcaagttctacaagaaggagctcaagcagatcctgaacaagcagaaggagttcatccccgagctgcaggacgcgagcctctacgaggcctgcatcaaggagctgtaccggaacaacgaggcccacatccagtccatcgccaacaaggacttcaccgacctgttcgtcaacgacatcatcttctaccagcgccccctcaagagcaagaagtccaccatcagcaactgcccctacgagagctactactacaagaacaaggagaccggcgagctgatccggaagccgatcaagtgcatcgccaagtccaaccccctgtaccaggagttccgcctctggcagttcgtgcacaacctgcggatctacaagaagtccgaggaggtgagcgggcgcctgcagacggacgtcgacgtgaccgaccggttcctcaccacccccgacgactacgcgaagctgttcagctggctgaacgaccgcaaggagatcaagcagaaggagctcctgcggtacgaggccttcggcctgtccaagagctacggggactaccgctggaacttcgtggaggacaagccctacccgtgcaacgagacgctccacgagatcaaccggcgcatgaagtccatcctgagcgacaagaagctgtccagcgaggcctaccagcagctctggcacatcctgtactccatcgacgaccccatcgagatccggaaggccctgaccagcttcgcccagaaccaggagatcaactccgacgacttcgtcaacgcgttctaccagtacgtgcccgagaagaccaagagctacggcgcctactccgagaaggccatcaagaagctcctgcccctgatgcgccgggggagctactgggccatcggcaacatcgacgagaagacccaccgccgcctggacaacatcatcaacggcgtggccgacgactccatcagcacgtgcacccgggagaagctcaacaacctgaccgacatcaccatgtgccaggggatgccgctgtggcaggcgtgctacgccgtctacgaccgccactccgaggccgccgacacgaccaagtgggagcagcccgacgacatcgacacctacctcagcaccgagctgaagcagcacagcctgcggaaccccatcgtggagaccgtcatctccgagacgctccgcgtggtgcgggacatctggaaggcgtacggccgccccgaggagatccacgtcgagctggggcggaacctgaagcaggacgccaagagccgcaagcaggacgccatccggatggccgagaacgagcagaccaacctccgcatccgggccctgctgcaggagctctccaacccggagtgcggcgtggagaacgtgcgcccccacagcccctcccagatggagctgctgaagatctacgagaacgaggtcctccagagcaccgacgacatccccgaggagatctccaacatcatcaaggacctggggaagaccgacagcaagaagcggccgtccctgagcgacatcacgaagtaccgcctctggctggagcagaagtaccagtccccctacaccggccacatcatccccctgagcaagctgttcaccccggcgtaccagatcgagcacgtgatcccccagtcccggtacttcgacgacagcatctccaacaaggtgatctgcgaggccgaggtcaacaaggagaaggaccgcatgctgggctacgagttcatcatcaacaagggcgggagcatcgtgaaggggtccttcggccagcagttcaagatcttcgacaaggtgcagtacgaggacttcgtcaagcagcggtacgcccacaacaagaccaagatgaagaagctgctcatggacgacatccccgacgggttcatccagcgccagctgaacgacagccggtacatgagcaagaagatcatctccatcctgagcaacatcgtgcgcgaggacggcgagaaggaggccacgtccaagcacatcatcgtgaccagcggcgccatcaccgaccggctcaagaaggagtgggggatcaaggacgtctggaacgacatcatcgcgccccgcttcaagcgcctgaacaagctgaccgactccaacaactacggcatggagacggagaaggaggggcggcagtacttccagatcaacgtgccgaccgagctcagcaccggcctgatcaagaagcgcatcgaccaccggcaccacgccatggacgccatcatcatcgcctgcaccacgcgcaaccacgtgaacttcctgaacaactccaccgccgcgagcgaccagaaggacatccggcgcgacctccagcacaccctgtgcaccaagacgaagaccgactccaacggcaactacgtctggcggttcaacaagccctgggacaccttcacccaggacacgcgccaggagctggaggggatcatcgtgagcttcaagcagaacctccggatcatcaacaagatgtccaactactaccagcactacgtggacggccgcaagaccatcagccggcagaacaagggggacggctgggccatccgcaagtccctgcacaaggccaccgtcagcgggaaggtgaacctgaagcggtccaagaccgtgggcttcaaggaggccctcaacgactggagcgcgatcaaggacaagacgtccaaggccatcctgcagaagatcatcgcccagtacaagaactacgaccccaagaccatcttcaagtacttcaaggaccgcaacttcaaggtcgagggcaaggacttcagcaagctggaggtgtactacaacacctccgacaaggagcccatgagcgcccaccgggtgaacatcgacaccacgttcgacgagaaggagatccgcagcatcaccgacaccgggatccagaagatcatgctcaagcacctccacacctacgacgacgcccagggcaagacgcacccggaggcggccttctcccccgaggggatcgagaagatgaaccagaacatccggatgctgaacggcgggaaggaccacaagcccatcttcaaggtccgcaaggccgagatcctcggcatgaagttcgccgtgggcgagcgggggcacaaggacaagaagtgggtggaggccgacaagggcaccaacctgttcttcgcgatctacgagagcgaggagaacaagcgctcctacagctccatccccctgaacgaggccatcgaccgcctcaagcgcggggagaacatcgccgacgagcgggaccagaacggcaacaagctgctgttcgtcctcagcccgatggacctggtgtacgtgcccgaccccgacgacgcccacatcgacgaggtcaaggggaacaacaacatcttcaagatggtgtcctgcaccggcaccgagtgctacttcgtgcccgagacctacgccaacgtcatctgcaagggcaaggagctggagagcaagaacaaggtggagtcctacgacgggatcaacatcaagaagtcctgctacaagatcacggtggaccggctcggcaaggtccgcaagatcttcaaggggtga

SEQ ID NO: 2250 - RNA, 4491 nt, synthetic construct
  misc_feature 1..4491: note = Cas9 variant
  source 1..4491: mol_type = other RNA
atgaagaccatcctgggcctcgacctggggaccaacagcatcggctgggccaaggtgtgcgtcgacgacaacgggaactacctgcgcgacatcaagctcggctcccggatcatccccatgagccaggacgtgctggggaacttcgacaagggcgtgacggagtcccagaccagcgtccgcaccggcttccgcggggtgcggcggatccgcgagcggtccctgctccgccgggagcgcctgcaccgggtgctgcacgtcctcggctacctgccgccccactacgacagcgccatcgggtggaacaagaacgagccctccacctacggcaagttcctgaaccacggggagcccaagctcgcgtgggagcacaaggaggacggcagcatgcgcttcctgttcatggagtccttccacgagatgatggccgacttcgccaagagccagccgtccctggtgagcgacggcaagaagatccccctcgactggacgatctactacctgcggaagaaggccctgtcccagcccatccgcaaggaggagctcgcctggctgctgctcaacttcaaccagaagcgggggtactaccagctgcgcggcgaggaggacgacgacaaccccaccaagtgcgaggagtactacgagctgaaggtggtcgggatcgaggcggacgaggagggcaagaacggcaacacctggtacaacgtgaagctcgagaacgggtggatctaccggcgccagagcaagatcccgctggacgactggatcggcaaggtgcgggagttcatcgtcaccacggagtacgagaaggacgggatcaccctgaagaaggacaagaacggcgacgtgaagcgctccttccggagcccctccgaggacgactgggggctccgcaagaagcgcaccgagaagctgctggacagctccaagatgaccgtgggcgccttcgtctacgaccacctcctggccgagcccagcgacaagatccggggcaagttcatccgcacgatcgagcggaagtactacaagaaggagctgtacgccatcctctgcgagcagagcaagtaccacgaggagctgcgctccggggactacctgaacaagtgcgcggaggagctctacaagaacaaccagccccaccggaacagcctgctgaccaaggacctcgcctacctgctgctcgaggacctgatcttctaccagcgcccgctgaagaccaagaagtccctcatcgccgagtgcccctacgaggcctacaagtacgtggacaaggagaccggcgagatcaagcggcaggggatcaagtgcatcgccaagagcaacccctactaccaggagttccgcctgtggcagttcatctccaacctgcgcctcttcaacaaggcggacgacaaggaggtgacggccgactacctgcccacccaggacgactacgtccggctgttcgcctacctgaacgaccggaaggagatcaaccaggagaccctcctgaaggagttcttcaagctgaagaagatcaccgtgaacagcgagaaggtgttcccgatccgctggaactacatcgaggacaaggagaagaagtacccctgcaacgagacgcggcacgagctcctgctggccctcgaccgcgcccggatcgaccactcctggctggagaagcccggccaggagtaccgcctgtggcacctcctgtacagcgtcgagtccaaggaggagaccaaggaggcgctgcggaagctcaaggacgacgacgccttcgtggagagcttcctgaaggtgaagcccttcaagcgcgagtacggggcctactccgagaaggccatcaagaagctgctcgccgtcatgcggatgggcagcctgtggcgcgagaccgacatctgcgacaccacgaagggcaacatcaccaagatcctgcagggggagatcgacgagaagctcaaggagaagatctccgcgagcgtgtccagctacaaccagctgtccgacttccagggcctgccggtctggctcgcctgctacgtggtgtacgggcgccacagcgaggccgccgagatccagcactggaagacccccgagtccctgctggcctacatcaacggcttcaagcagcacagcctccggaaccccatcgtcgagcagtgcatcctggagaccctgcgcacggtgcacgacatctggaaggaggtggggcacatcgacgagatccacgtcgagctcggccggaacatgaagtccaccgcggaccagcgcgcccggatcagcgagaacgtgctgcgcaacgagaacaccaacctgcggatcaagagcctcctgctggagctcaagaacgaccccaacatcaaggacgtgcgcccgtactcccccatgcagcaggagaagctgcggatctacgaggagggcgtcctgcaggagctcaccaaggacgacaaggacttcacggagatcaccaagatcagcaccatggcccagccctccgccaaggagctgcagcgctacaagctgtggctcgagcagaagtaccggagcccctacaccgggaagtccatcagcctgacgaagctgttcacctccgcgtaccagatcgagcacgtgatcccgcagagccgctacttcgacgactccttcagcaacaaggtgatctgcgagtccgaggtcaacagcctcaaggacaacatgctgggctacgagttcatcaagaaccacgggggcgagatcatccactgcaccatgctgggcgacgtgaaggtgctctccgagagcgagtacaaggccttcgtcaacgaccactacgcccacaacaagcggaagcgcgagaacctgctgctcgaggacatcccccaggagttcctgaaccggcagatgaacgactcccgctacatcagcaaggtggtgaaggccctgctcagcaacatcgtccgggccgagggggaggaggaggcgacctccaagttcgtggtgagctgctccggcgggatcaccgaccgcctgaagaaggactggggcctgaacgacgtctggaacaagatcgtgtacccccggttcgagcgcctcaaccggctgacggggaccgaggccttcggccagtgggagaacaaggacggcaagcgcgtgttccagaccgccgtcccgctggagctccagcgcgggttcaacaagaagcggatcgaccaccgccaccacgccatggacgccctggtgatcgcgtgcaccagccggaacatcatcaactacctgaacaacgagtccgccaacaaccccaagaagcgcgaggacctccggcagaagctgtgcgacaagaaccgcacgatccggaagccctgggagaccttcacccaggacgccaccgccgccctggaggacgtgatcgtcagcttcaagaactacgtgcgcatcatcaacaaggcgacgaactactacgagcggtacgacgtggagggcaagaaggtcatcgccgagcagcgcggggacgacatgtgggccatccggaagcccatgcacgaggccacctactacggccgcgtgaacctccggcgcaagaagaaggtgaacctgcgggtcgcgctggagaacatctccagcatctgcgacaacaagctccgcatctacatcaacgggctggtggagaagggcttcaacaccaagcagatcctggacaagttcaagaacaccaacgaccacttctccatgcagaagatcgacaaggtggagatctggcagttcacgaacgaggaggagaagctcgtcgccacccggaagccgctggacaccagcttcgacaccaagaagatcgcctccatcacggacaccggcatccagaccatcctgctcaactacctggagaccaagggcggggacagcacgatcgccttcacccccgaggggatcgtggagatgaaccagaacatctccaagtacaacaacggcaaggagcacatgcccatcctgaaggtgcgcctctacaccaagctggggaagaagatccccgtcggccagaccggctgcaaggccaagcagttcgtgatcgcggaggccgggacgaacctgtacttcgccatctacgaggacgaggagggcaagcggagctaccgcaccatcccgctcaacgaggtggtcgagcgcctgaagcaggggctgtcccccgtgcccgagaagaacgacaaggacgtgcacctcaagttctacctgagccccaacgacctggtctacgtgccgatcgaggacgagcacgagtccctcgccaaggaccacatctacaagttcgtggacagctccggcaccaccgccaacttcatcccccaccggagcgcgaacgtcatcttcgagctgaacaagaaggacgccgagaagttctgcagcgggtccatcatccagaacgagtacggcgtgggcagctcccagagcaagaaccagaaggccatcacgggggagatgatcaaggccgtgtgccgcaagctggaggtcgaccggctcggcaacgtgatcaaggtcatctga

SEQ ID NO: 2251 - RNA, 4497 nt, synthetic construct
  misc_feature 1..4497: note = Cas9 variant
  source 1..4497: mol_type = other RNA
atgaagcacatcctgggcctcgacctggggaccaacagcatcggctgggccgtgatccgcgcccaccaggacgcggacgggcacaccacgctgcaggacatcctcgccgccggctcccggatcatccccatggacgccgccaccctgaccgacttcgacaaggggaacgcgcgcagcggcaccgccgagcggacgtccttccgcagcatgcggcgccggcgcgagcggcagctgctccgccgggagcgcctgcaccgggtcctgatgctcctgggcttcctgccgcagcactacgccaactccctcacccgctacggggagttcgccgacaaccgggagtgcaagctgccctgggtgaaggacgagagcgacggcaagtaccacttcctgttccaggacgcgttccacgagatgtgcgaggacttccgccagctcgcgccccagtgggtggccgacgggaagaaggtcccctacgactggaccctgtactacctgcggtgcaaggccctctcccgcaagatcagcaaggaggagctggcctggatcctgctctccttcaaccagaagcggggctactaccaggcccgcgacgaggaggacgaggtgaccacgaacaagctggaggagtactacgccgggaaggtggtccgggtggacgacaccggcgagcgcaagggcaagaacgtgtactacgacatcaccctggagaacgggtgggtctaccgctacgccgcccggatctacccggactgggtgggccaggtgaaggagttcatcgtcaccacgaccctcaaccccgacgggacccccaagaccgacaaggccggcgaggtgaagcgcagcttccggatgcccaaggacgacgactggacgctgatcaagaagaagaaggagcgcgacatcgaccggtcccaggagaccatcggccagtacatctaccacgcgctgctcaaggacccgagccagaagatccgcgggaagctgatcggcaccgtggagcggaagtactacaaggacgagctgcgccggatcctcgaccgccagatccagttccaccccgagctgcgggaccgcgagctgtactacgcctgcctccaggagctgtacccctccaacgtcgccttccggaacaccctggtgaaccgcgacttcacgtacctcttcctggacgacatcctgttctaccagcggcccctcaagagcaagaagtcccagatcagcgactgcccgtacgaggagcacttctacaccgacaaggagaccggggagcgcatctccgtgcccgtcaagtgcatcgccgtgagccaccccctgtaccaggagtaccggctgtggcagttcatccagaacctccgcatctactgccgggaggcccgcatcgacggcaacctgatgatcgactgggaggtgaccaacgagctgctccagacggaggaggacaagaccgcgctgttcgactggctgaacgacaaggagtccgtcaagcagcccgagctcgtggccttcctgctcgggggcaaggccaacaagaagcagatcaaggcctaccgctggaactacatggacgacgacaccaagggctacccgtgcaacgagacccgggccagcctgctcaagtacctgcgcgaggcgcagacggacagctccttcctgacccgggagcgcgaggaggccctctggcacatcctgtacagcatctccgacaagggggagctcaagagcgccctgggcaagttcgccgtgaagcacgggctgaacgagcggttcgtcaccgtgttctccaagttcccgcccttcaagaaggactacggcagctactccgcgaaggccctgaagaagctcctgcccctgatgcgcatggggcaccactggcaggaggccagcttcatcccctccacccggcagcgcatggagaagttcatcaacggcgagtacgacgacagcatcgacaagcggacgtacgagaagctcgagtccctgaccgaggtcagccagtaccgcggcctgcccgggtggctcgcctgctacgtggtgtacgaccggcactccgagggccgcgacatcgagcggtggaccagcccctccgacatcgacagctacctggcccagttcaagcagcactccctgcacaaccccatcgtcgagcgcgtggtgctcgagaccctgcggacggtccgcgacatctggaagcaggtcgaccacatcgacgagatccacatcgagctggggcggaacatgaagctcccggcggacaagcgccggcagatgaccgagcaggcctggaagaacgagcagaccaacctgcgcatcaaggccctgctcctggagttcgcccggcccggctacgacatcgagaacgtgcgcccctacagcccctaccagcaggaccagctgcgcatctacgaggaggccgtgctcggggcgaacgagtgcccggacgacatctccgccatcctgaagaagttcaacggcctgaacccgcccaccagcgccgaggtgctccggtacaagtgctggctggagcagaagtaccgcagcccctacaccggccggacgatccccctgtccaagctgttcaccagcgcctacgagatcgagcacatcatccccaagcagcgctacttcgacgactccttcagcaacaaggtgatctgcgagtccgaggtcaacaagaagaagggggccatgctgggctacgagttcatcaagagctaccacggggcgtccatcaccctgaaccggggcggcaccgccagcatcttctccgtggaggcctacgagaacttcgtgaaggagcactacgcccacaaccgcgggaagatgaagaagctcctgatggacgacgtccccgacagcttcatctcccggcagctgaacgacagccgctacatctccaagctcatgaagtccatcctgagcaacctggtgcgggaggagggcgagaaggaggcgatcagcaagaacctcatcgtgtgcaccgggggcatcaccgaccgcctgaagaaggactgggggatccacgacgtctggaacgacatcatcttcccgcggttcaagcgcctggacgagatggactccagccacacctacatcaccctcaacacgcaccggcaccccatccccagcatgcccctggagttccagcgcggcttctccaagaagcggatcgaccaccgccaccacgccatggacgccatcgtgatcgcctgcgccacccggaacatcgtgaactacctgaacaacgagagcgcgcgccacgacgccaagacctcccggatggacctccagcgcctgctgtgcaccgccaaccgcaagctcatcgacaagccgtggaagacgttcacccaggacacgtgcaaggtcctggaggacatgatcgtgagcttccagcggaccctgcgcatcatcaacaagacgaagaactactacctccggttcgaggacggcaagaagcgccgggtgctgcagaccaagggggacaactgggccatccgcaagcccctgcacaaggagaccttctacggcgagatcaacctccggcgcatcgagaccctgtccctgaacaaggccctcgagcggatccccgacatcgtcgagcgcgacctgcggaagaagctgagcgagctcctgtccctggggtacaacgcgaagcgcatcaagggctacttcgaggagcacaaggaggagtggagcgacgtgaacctctccaagatcaaggcctactacttcacgaagcagaagaacaagcggtacttcgccgcccgcaccgagctggacaccagcttcaacaaggacaagatcgagaacaagatcgccgacaccgcgatccagaagatcctgctccagcacctggaggcctacgggaacgacgtggagcaggccttctcccccgagggcatcgacacgatgaaccggaacatccgccagctgaacggcgggcggagccaccagccgatctacaaggtccgcgtgtacgaggaggccaccaagttcgcggtgggccggcgcgggaacaagtccaccaagttcgtcgaggccgccaagggcaccaacctcttcttcgccatctacgagatcagccaggtggacgggaacggcaaccggcagacgtcccgcaccttcagctccatccccctgaacgtggccgtcgagcgcctgaagcagggcctcccgcccgtgcccgaggacgaggaggggaacgcgcccaagtacgtgctgagccccaacgacctggtctacctccccaccgagaaggagctgaagcggcgcgagatcgccatgccgatcgacaagtcccggatctacaagatggtgagctgcaccggcaaggactgcttcttcatccccgccaacacggccgtgcccatcgtcgaccgctacgagtacagctccatgaacaagatcgggcgggccctgaccggcgagatgatcaaggagatctgcctccccctgaagatcgaccgcctggggcagatcatcgagatcagcaccttctga

SEQ ID NO: 2252 - RNA, 4506 nt, synthetic construct
  misc_feature 1..4506: note = Cas9 variant
  source 1..4506: mol_type = other RNA
atgaagaagatcctgggcctcgacctggggaccaacagcatcggctgggccgtgatcaacaaggccgagaacgaggggaaggacgtcctgtgcggcatcgaggcggccgggtcccgcatcatccccatggacgccaccatcatgggcgacttcgagaagggcaacagcgtgtcccagacgaaggaccggcgcgagcaccggagcacccgccggctctacgagcgcgggaagctgcggcgcgagcggctgaaccgcgtgctctccgtcatgggcttcctgccggaccactacgtgagccagctggaccggtacgggaagttcctctccaacaccgagcccaagctggcctgggtgcgcaacgccgactgcaagtaccacttcctgttcatggacagcttctccgagatgctccaggagttcaagaccaacagcccccagtacatctccgaggagagcaaggtcccctacgactggacgctgtactacctgcggaagaaggcgctcacccacaaggtgaccaaggaggagctggcctggatcctgctcaacttcaaccagaagcgcggctacttccagctgcgggacgagtccgaggaggagaagaagccgagcaagatccgccagtacttcgagcaccagaaggtggtcgacatcatcgacaccaacgaggtgtacaaggggctgaaggtgctcatcgtcatcctggccaacggcatctccggcaagatcttcaagaaggagatccccgactggatcggggtggagaaggacatcatcgtgaaggtcgacatcgacaaggacggcaaggacaagttcaacgaggacgggagcctgtcctgccggttcaacatccccacggaggccgagtgggacaccgagtgggagctcatcaagcagaagacccagaacgacctggacgcgagcggcaagaccgtgggcgagtacatcttcgacacgctgctccgcaaccccgagcagaagatccgggggaagctggtgcgcaccatcgagcggcgctactacaaggaggagatcaacgccatcctgaagaagcagaaggagttccacccggagctctccgaccgcgccctgtacgagaagtgcgtcgaggagctgtaccccaacaaccccgcccaccggaacatgatgctcatccacgacctgagctacttcctggtgaacgacatcctcttctaccagcgccccctcaagagcaagaagtccctgatcgacgagtgcccgtacgagagccacctctacatcgacaagaagtccggcgagcggaagcccgtggccgtcaagtgcatcgccaagagccaccccctgtaccaggagttccgcctgtggcagttcatctccaacctccggatctaccagaagaccaaggaggtggggaacagcctgaaggtggacgtcgacgtgaccaacgagttcctgaagggcgagaacgactacgtcgagctgttcgactggctgaacacgaagaaggagatcaagcaggaggacttcctgaagtacaagcccttcgggttcaccaagggcaacatcaacaactaccgctggaactacgtggaggacaagatctacccgtgcaacaagacccactacaccatcctcaagggcctggagaaggcggacatcacgttcgacgagttcatctcccacgacagcctggccgaggagaacctgtggcacatcctctactccgtgagctccaaggaggagctgaagcacgccctggagagcttcgccgacaagcgggggctctccatcaagttcgtcgacgcgttcatcaacacccccgccttcgagaagtcctacggcgcctacagcgccaaggccatcaagaagctgctgcccctcatgcgcatggggaagtactggaaggaggagaacatctgcgacagcacccgggagcgcatcgacaagatcatcaccggcgagtacgacgagaacatccgggaccgcgtgcgggagaagtccatcaacctgacggacatcaccctgttccgcgggctccccctgtggctggcgtgctacgtggtctacgaccggcacagcgaggccggcaacaccgagcgctggacctccccgagcgacatcgaccactacatccggaagttcaagcagcacagcctccgcaaccccatcgtggagcagatcgtgctggagacgctgcggaccgtccgcgacgtgtggaccgaggtgggcgggatcgacgagatccacgtcgagctcggccgcgagatgaagaacccctccgacaagcggcgcaagatgagcctgcagatgcaggagaacgagaacaccaacctgcggatcaaggccctcctggccgagttcatcaaccccgagctggggatcgagaacgtgcgcccgtactcccccagccagcaggacctcctgcggctgtacgaggagggcgcctggaactcccccgagatcgacgagaagcaggtcgacgagatgctcgcgatcctgaagaagttcaacgagacggacagctccaagcgccccaccaagagcgagatcaagcggtaccgcctgtggctcgagcagaagtaccggtccccgtacaccgggacccccatccccctgagcaagctgttcacgaccgcctacgagatcgagcacgtgatcccgcgctcccggttcttcgacgacagcctcaccaacaaggtgatctgcgagtccgaggtgaacaagctgaagggcaacatgctgggctacgagttcatcaagagccactacggggagaaggtccagctctccagcggctccgaggtgcagatcttcagcgtgaacgactacgagaagttcgtcaaggaccactacagcaagaacaaggccaagatgaagaagctgctgatggacgacatccccgagaagttcaccgagcgccagatgaacgactcccggtacatcagccgcctcatcgtgtccctgctgagcaacatcgtgcgggagaagggggagcaggagtccatcagcaagaacgtcctcgtgtgcaccggcggcgtgacggaccgcctgaagaacgactggggcgtcaacgacgtgtggaacaagatcatcctgccccggttcaagcgcatgaacgagatcaccgactccaccgactacaccagcgtgaacacgtccgggcacatcatccccgccatgccgctccacctccagaaggggttcaacaagaagcggatcgaccaccgccaccacgcgatggacgccatcgtcatcgcctgcgccggccggaacatcgtgaactacctgaacaaccagagctccaagagcgacgtgtcccgccacgacctgcgcaacctgctgtgcgagaaggacaagagcgaccggaaggagctcatcatcaagccctgggacaccttcacccaggacgtctactccgtgctgagctccatcatcgtgagcatcaagcagaacctgcgcgtcatcaacaagaccaagaacatctaccagcggaaggaggacgggaaggtgatcatctccaagcaggagaacaacatcaactggtgggccatccgcaagcccctccacaaggagacggtgagcggcgaggtcaacctgcggaaggagaccaccatcagcctgaaggaggcgatcgacaaccccgcccgcatcatcgacaaggacttcaagaagaagctccgggagctgatcctgatgggctacaacgagaagctcatcaagaagtacttctacgacaacaacgagtcctggcaggacgtgaacctgaagaagatcccggcctactacttcaccaaggacacgaacgaccgctacttcgccagccggtccctgctcgacgagaacttcgacaagaagaagatcgagaacaaggtgaccgacaccgggatccgcaccatcctgctgcggcacctcgaggtcgagggcggggacagcaaggtggccttctcccccgagggcctggagcgcatgaacaagaacatcgagatcctgaacgggggcaagaagcacaagcccatctacaaggtgcgggagtacgagaaggcggagaagttcgccgtcggcatgcgcgggaacaaggccagcaagttcgtggaggccgccaagggcacgaacctcttcttcgcggtgtacgacaacgggaagaagcggtccttcgccaccgtccccctgaacgaggtgatccgcctgcagaaggagggcctcccgagcgcccccgccaacgaggaggggctgctgcccaagttcgtgctctcccccaacgacctggtctacgtgccgaccgaggacgagctgcggagcggcctcctgcccgagaaccccgcgcccgagcgcatctacaagatggtctcctgcaccggctaccagtgcttcttcatccacttcagcgtgtccggggtgctgtgcgacaagaaggagttcagctccctcaacaagatggagcgggccatcagcggcgagatgatcaaggagatctgcatcccgctgaaggtcaaccgcctggggaagatcatgtacaacctctga

SEQ ID NO: 2253 - RNA, 4506 nt, synthetic construct
  misc_feature 1..4506: note = Cas9 variant
  source 1..4506: mol_type = other RNA
atgaagaccatcctgggcctcgacctggggaccaacagcatcggctgggccaagatctccatcgacgacaacgggaactacctgcgcgacatccagctcggcagccggatcatccccatgtcccaggacgtgctggggaagttcgacaacggcgtcacggagagccagaccgccgtgcgcaccggcttccgggggctgcgccggatccgcgagcggtccctcctgcgccgggagcgcctgcaccgggtgctccacgtcatgggcttcctgccgccccactacgacagcgcgatcgggtggaacaaggaggagccctccacctacggcaagttcctgaaccacggggagcccaagctcgcctgggagcgccagggcgacggcagcatgcggttcctgttcatggactccttccacaagatgatggaggacttcgccccgcaccagcccgccctggtggccgacgggcgcaagatccccctcgactggacgctgtactacctgcggaagaaggcgctcacccagcccatcaagaaggaggagctggcctggatcctgctcaacttcaaccagaagcgcggctactaccagctgcgcggggaggaggaggaggagaacccgaccaagcgggaggagtaccacgagctgaaggtggtcagcgtggaggccgccgaggagggcaagggcgggaacacctggtacaacgtgaagctcgagaacggctggatctaccaccggccctccaagatcgacctgagcgactgggtcgggaagacgaagcagttcatcgtgaccatggagtacgaggcggacggcatcaccctgaagaagaacaaggagggggaggtgaagcgctccttccgggtccccgacgaggacgactggggcctccgcaagaagcgcaccgagagccagctggaggcctccggcaagacggtgggggccttcatctacgaccacctcctggccgagcccgccgacaagatccggggcaacttcatccgcaccatcgagcggaagtactacaagcaggagctggcggacatcctgcgcgagcagagcaagtaccacgaggagctccagtccaagaagatcctggccgactgcgccgaggagctgtaccggagcaaccagccgcaccgcgactccctcctgaagaaggacatggtgtacctgctcctgaccgacctgatcttctaccagcggcccctcaagagcaagaagtccctgatcgccaactgcccctacgagtactacgagtacgtcgacaaggagaccggggagatcaagcgccagggcatcaagtgcgtggccaagagcaacccctactaccaggagttccggctgtggcagttcgtgctcaacctgcgcctgtacgaccggacggaggacaaggaggtcaccgcggagtacctcccgagcaaggaggactacgcccgcctgttcgtgtacctgaacgaccggaaggagatcaaccaggagaccctgctcaaggacttcttcaagctgaagaaggtgaagcagcgctccgagaaggagttccccgtccggtggaactacatcgaggacaaggagaagaagtacccctgcaacgagacccgccacgagctgctcatggccctggaccgggccgggatggagcgcagctggctggacgacacggcccggcagtaccgcctctggcacctcctgtactccatcgaggtgaaggacgaggcggagcgcgccctgcggaagctgaaggacgacgacgagttcgtgagcgccttcctgaaggtcaagcccttcaagaaggactacggcgcctactccgagaaggccgtgaagaagctcctggcggtcatgcgcatgggcagccactggtgcgaggacgacatctgcaaggagaccaaggagcggatcgagcacatcctgcagggggacgtggaggagaagatcaaggagcgcatgaaccacaccgcctactccctcggcgagctgagcgacttccaggggctgccggagtggctcgcctgctacgtggtctacggccggcactccgaggccaccgacatcaagcactggaagacgcccgagagcctgatggcgtacatcaacgggttcaagcagcactccctgcgcaaccccatcgtggagcagtgcatcctcgagaccctgcggaccgtgcacgacatctggaaggaggccggccacatcgacgagatccacgtcgagctgggccgcagcatgaagtccaccagcgaccagcgggcccgcatgacggagaacatcctccggaacgagaacaccaacctgcgcatcaagtccctgctcatggagctgaagaacgacgccgacatcaaggacgtgcggccctacagcccgatgcagcaggagatcctgcgcatctacgaggagggggccctccaggagctgaccaaggaggacaacgactacgaggagatcttcaagatctccaagatcccccagcccagcgcgaaggagctgctcaagtacaagctgtggctggagcagaagtaccggagcccctacaccggcaagccgatctccctcagcaagctgttcacgtccgcctaccagatcgagcacatcatcccccagagccgctacttcgacgactccttcaacaacaaggtgatctgcgagagcgaggtcaacgccctgaagtccaacatgctcgggtacgagttcatcaagaaccacggcggcgagatcgtgcactgcaccctgctgggggacgtgaaggtccagaacgagagcgagtacaaggccttcgtgaccgagcactacgccaacaacaagtacaagaaggagaagctcctgatggaggacatcccccaggacttcctgaaccggcacctcaacgactcccgctacatcagcaaggtggtcaagaccctgctgtccaacatcgtgcggacggaggacgagatggagaccaccagcaagttcgtggtctcctgcaccggcgggatcaccgaccgcctcaagaaggactggggcctgaacgacgtgtggaacagcatcgtgtactcccggttcgagcgcctgaacgagctcaccaagagcgacgcgttcgggcgctgggagaacaaggagggcaagcgggtcttccagacgtccgtgccgctggagctgcagcgcggcttcaacaagaagcggatcgaccaccgccaccacgccatggacgccctcgtgatcgcctgcgccagccggaacatcatcaactacctgaacaacgagagcgcgaactcccccaagaagcgcgaggacctgcggcagcagctctgcgacaagaaccgcatcatccggaagccctgggagagcttcacccaggacgcccgcgccgccctggaggacgtcgtggtgtccttcaagaactacgtccgggtgatcaacaagaccacgaactactacgagcgctacggggcggacggcgagaagaccatcgccaagcagaagaacagcgagatgtgggccgtgcggaagcccatgcacgaggccaagtactacgggcgcgtcaacctgcagcggaagaccgaggtgcgcctcaaggccgcgctggaggacatcccgtccatctgcaacaaggagctgcgggactacatcaaccgcctcgtcaagagcggcctgaacgcccggcagctgctcgcccacttcaagtccaccgactactgctggaacaagcagaacgtggacaaggtggaggtgtggcgcttcagcgacgagaaggagcccctggtcgccatccgcgagtccctggacacgagcttcgacgccaagcggatcgacaccatcaccgacaccgggatccagaagatcctcctgaactacctggaggcgaagggcggcgaccccgccatcgccttcacgcccgaggggatcgccgagatgaaccagaacatggccctctacaacaacggcaagatgcaccagccgatcctgcgcgtgcggctgtccaagaagcgcgggaagaagtaccaggtgggccagaccgggtgcaaggcgaagcagttcgtcatcagcgagtccggcaccaacctctacttcgccatctacgaggacgaggaccggaaccgcacctacaacacgatccccctgaacgaggtggccgagcggctgaagcagggcctcagccccgtgcccgagaagaacgagaaggaggtcccgctgaagttctacctgtcccccaacgacctcgtgtacgtgcccaccgaggaggagatcctgatgaaggagtgcaagctgaacaagaaccgcatctacaagttcatcgacagctccgggaccaccgccaacttcgtcccccaccggagcgcgtccctcatctacaacgtggacaagaagctggccgaggccttctgcaacgacgagatcatccagaacgagtacggcgtggggagcccgcagagcaagaaccagaaggccctgacgggcgagatgatcaaggccgtctgctggaagctcgaggtggaccgcctggggaacatcatccgggtgatcaagtga

SEQ ID NO: 2254 - RNA, 4515 nt, synthetic construct
  misc_feature 1..4515: note = Cas9 variant
  source 1..4515: mol_type = other RNA
atgaagaacatcgtgggcctggacctcgggaccaacagcatcggctgggccgtcgtgaacgggaacatcaacgacgacggctccgagcagctggtgaagatccaggccagcgggtcccgcatcatccccatggacgcggccatgatcggcgacttcaacaagggcaacagcatctcccagaccgccgagcggacgcgcctgcgggggatccgccggctcagcgagcgctacctgctgcggcgcgagcggctccaccgcatcctggacatcctgggcttcctcccgtcccacttcgcccgggacctggaccgctacgggaagatcgtcaaggacaaggagcccaagctggcctggcggaagaacgaggcgggccagttcgagttcatcttccagaacagcttcaaggagatgctcgaggacttcaagctgaaccaccccaacctgatcaccgacgacaagaaggtgccctacgactggaccatctactacctccgcaagaaggggctgacctccaagatcagcaaggaggagctggcctggatcctcctgaacttcaaccagaagcggggctactaccagctgcgcggcgaggaggaggaggagaacaagaacaagcaggtcgagttctacgccctcaaggtgatcgccgtggaggactccggggagaagaagggcaaggacacgtggtacaacgtgcacctggagaacgggtggatctaccggcgcaccagcaacatgccgctggactgggtcggcaagaccaaggagttcatcgtgaccacggacctcgagaaggacggcacccccaagaaggacaaggaggggaacatcaagcggtccttccgcgcgcccaaggaggacgactggagcctggtgaagaagaagaccgaggccgacatcgaccagacccacaagacggtcggcacctacatctacgacaccctgctcgggaacccctcccagaagatccggggccgcctggtgcgcaccatcgagcggaagtactacaaggaggagctgaagctcatcctggacaagcagaaggagttccacccggagctgcaggaccgcgccctctacgccgcctgcgtggaggagctgtacacgatcaacgaggcgcaccggaacaacatcgggaaccgcgacttcacctacctgttcctcgaggacatcctgttctaccagcggcccctcaagagcaagaagtccctgatcgacaactgcccctacgaggagaaccactgcctggacaaggagaccggcgagatcaagttcttccccgtcaagtgcatcgccaagagccacccgctgttccaggagttccgcctctggcagttcatcgtgaacctgcggatctaccgcaagggcctggcccaggacgtggacgtcaccaacgagctcctgaagacggaggaggactacgtggccctgttcgactggctcaacgggaagaaggagatcgaccagaaggccttcctgaagtacccgcccttcggcctgaagaaggaggtggagaactaccggtggaactacgtccaggacaagtcctacccctgcaacgagacccgcagcctgatgctcgcgcggctggagaagtgcgacatcagcatcgagttcctgaccaaggagaacgaggaggccctctggcacatcctgtactccgtggaggacaagaacgagatcgtgaaggccctgcagaagttcgccgacaagcacaacctcaacgccagcttcgtcgacgtgttccagaagttcccctccttcaagaaggagtacgggagctactccgcgaaggccatcaagaagctgctgcccctcatgcgcatgggcaagtactggagcgaggactccatcgacaaggggacccgggagcgcatggacaagatcatcacgggcgagtacgacgagaagatcgagaaccgggtccgcgagaaggccatccacctggccgacatcagcgagttcaagggcctgcccctctggctggtgtgctacatcgtgtacgggcggcactccgagagcaaggagatcgccaagtgggagtcccccgcggacatcgacagctacctgaagtccttcaagcagcacagcctccgcaacccgatcgtcgagcagatcatcatcgagaccctgcgggtggtgcgcgacatctggaagcaggtcggcaacatcgacgagatccacgtggagctggggcgcgagatgaagaaccccgccgacaagcggcgcaagatgacccagcagatctccgagaacgagaacaccaacctccggatcaagtacctgctgacggagttcctcaaccccgagtacgaggtggagaacgtccgcccctacagcccgtcccagcaggacatcctgcggatctacgaggagggcgtgctgaacagcgtgtccaacctccccgaggagatcagcgacatcctgaagaagttcaccgagaccgacctgaagaagcgccccagccggtccgaggtcctccgctacaagctgtggctggagcagaagtaccggagcccctacaccggggaggtgatcccgctcggcaagctgttcacgcccgcctacgagatcgagcacgtgatcccccagtcccgctacttcgacgacagcttctccaacaaggtcatctgcgaggccgaggtgaacaagctcaagagcaacctgctgggccacgagttcatcgtgaagcaccacggggagatcgtcgagctgccgttcggcaagaaggtgaagatcttcaccgtggacgagtacgagcagttcgtcaaggacaactactcccggacccgcgggaagatgaagaagctcctggtggacgacatccccgaggagttcgtggcgcggcagctgaacgacagccgctacatctccaaggtcgtcaagagcctcctgtccaacatcgtgcgggagaagggcgaggaggaggccatcagcaagaacgtgatcccctgcaccggcggggtgacggaccgcctgaagaaggactggggcgtgaacgacgtctggaacaagatcatcctcccccggttccagcgcctgaacgagctgaccgggaccaacaagttcaccaccatgtccctcaacaaccacgagatcccggccatgcccctggagctgcagaagggcttcaacaagaagcggatcgaccaccgccaccacgccatggacgccatcatcatcgcgtgcgccaaccggaacatcatcaactacctcaacaacgagagcgccacggccaaggccgagctgtcccgctacgacctgcagcgcctcctgtgcgacaaggcgaagaccgacgacaacgggaactacaagtgggtgatccggaagccctgggccagcttcacccaggacgtgcacggcgtcctggaggacatcatcgtgtccttcaagcagaacctccgcgtgatcaacaaggccaccaaccacttcctgcactacaacgaggagggcaagaagatcttcgtcaagcaggagaagggggacagctgggccatccgcaagagcatgcacaaggacacggtgttcggcgaggtgaacctgcggcggatcaagaccgtcgccctcaacgaggcgatgaagaacccccagtccatcgtggtgaaggacttcaagcgcaagctgctggagctcctgaacctggggttcgacgccaagcggatcaagaagtacttcgaggacaaccgcgagacctggagcgacatcaacctctccaagatcaccgtctactacttcagcaaggacacgaaggaccggttcttcgccacccgcaagccgctggacacctccttcgaccggaagaagatcgagaacaacatcaccgacacgggcatccagaagatcctgctccgccacctggagctgaaggacaacaaccccgacatcgccttcagccccgacgggatcgacgagatgaaccggaacatcatccagctcaacaacggcaagtaccaccagcccatcatcaaggtgcgctggtacgagcaggcggacaagttcgccgtgggccagaccgggaacaagtccagcaagttcgtcgaggccgccaagggcaccaacctgttcttcgccgtgtacgagtccaacatcctggacgagaagaccaacacgatcatcaagaagcggaactacgcgaccatcccgctcaacgtggccatcgagcgccagaagcaggggctgagcgtcgcccccgaggaggagaacggcaacgaccccatcttcgtgctgtcccccaacgacctcgtgtacctgccgaccaccgacgagctggccaacggggtcgtggcccagcccctcgacaaggagcggatctacaagatggtcagctgcacgggcaacgagggccacttcatccccgcgcgcatcgccaaccccatcctgcagaccatcgagctggggtccaacaacaaggcccagaaggcctggaccgacgagatgatcaaggagatctgcatgccgatcaaggtggaccggctcggcaacatcctggagagctccagcctgcacaagaagtga

SEQ ID NO: 2255 - RNA, 4515 nt, synthetic construct
  misc_feature 1..4515: note = Cas9 variant
  source 1..4515: mol_type = other RNA
atgaagaacatcgtgggcctggacctcgggaccaacagcatcggctgggccgtcgtgaacgggtccgtgaacgacgacggcagcgagcagctggtcaagatccaggcctccgggagccgcatcatccccatggacgcggccatgatcggcgacttcaacaagggcaactccatcagccagaccgccgagcggacgcgcctgcgcggggtgcggcggctctccgagcgctacctgctgcggcgcgagcggctccaccgcatcctggacatcctgggcttcctcccgttccacttcgcccaggacctggaccggcacgggaagatcgtgaagggcaaggagcccaagctggcctggcgcaagaacgaggcggggcagttcgagttcatcttccaggacagcttcaaggagatgctcgaggacttcaagctgaactaccccaacctgatcaccgacgacaagaaggtcccctacgactggaccatctactacctccggaagaagggcctgacctccaagatcagcaaggaggagctggcctggatcctcctgaacttcaaccagaagcgcggctactaccagctgcgcggggaggaggaggaggagaacaaggacaagctcgtggagttctacgccctgaaggtggtcgccgtggaggactccggcgagaagaaggggaaggacatctggtacaacgtgcacctggagaacggctgggtctaccggcggacgagcaacatgtccctcgactgggtgggcaagaccaaggagttcatcgtgaccaccgacctggagaaggacgggacgccgaagaaggacaaggagggcaacgtcaagcgcagcttccgggcgcccaaggaggacgactggtccctggtgaagaagaagaccgaggccgacatcgaccagacccacaagaccgtgggggcctacatctacgacacgctcctgggcaaccccagccagaagatccgcgggcggctggtccgcaccatcgagcgcaagtactacaaggaggagctcaagctgatcctggagaagcagaaggagttccacctcgagctgcaggaccgggccctgtacgccgcgtgcatcgaggagctctaccccatcaacgaggcccaccgcaacaacgtgggcaaccgggacttcacctacctgttcctggaggacatcctcttctaccagcgcccgctgaagtccaagaagtccctgatcgacaactgcccctacgaggagaaccagggcctcgacaaggagaccggggagatcaagagcttccccgtgaagtgcatcgccaagagccaccccctgttccaggagttccggctgtggcagttcatcatcaacctccgcatctaccggaaggacctggcccaggacgtcgacgtgacgaacgagctgctcaagaccgaggaggactacgtggccctgttcgactggctgaacggcaagaaggagatcgaccagaaggcgttcctgaagtacccggtcttcgggctcaagaaggagatcgagaactaccgctggaactacgtgcaggacaagccctacccctgcaacgagacccggagcctgatgctggcccgcctcgagaagtgcgacatctccatcgagttcctgaccaaggagaacgaggaggccctgtggcacatcctctacagcgtcgaggacaagaacgagatcgtgaaggccctgcagaagttcgccgacaagcacgacctgaacgcgtccttcgtggacgtcttccagaagttcccgcccttcaagaaggagtacggcagctactccgccaaggccatcaagaagctcctgcccctgatgcggatggggaagtactggagcgagaactccatcgacaagggcacgcgcgagcggatcgacaagatcatcaccggcgagtacgacgagaagatcgagaaccgcgtgcgggagaaggccatccacctcgccgacgtgagcgacttcaaggggctgcccctgtggctcgtctgctacatcgtgtacggccgccactccgaggcgaaggagatcatccagtggaagtcccccgccgacatcgacagctacctgcggagcttcaagcagcactccctgcgcaacccgatcgtggagcagatcatcatcgagaccctccgggtcgtgcgcgacatctggaagcaggtcgggaacatcgacgagatccacgtggagctgggccgcgagatgaagaaccccgccgacaagcggaagaagatgacccagcagatgagcgagaacgagaacacgaacctgcgcatcaagtacctcctgaccgagttcctgaaccccgagtacgaggtggagaacgtgcggccctactccccgagccagcaggacatcctccgcatctacgaggagggggtcctgaactccgtgagcgacctgcccgaggagatctccgacatcctcaagaagttcaccgagaccgacctgaagaagcggcccagccgcagcgaggtgctgcggtacaagctctggctggagcagaagtaccgctccccctacacgggcgaggtcatcccgctgggcaagctgttcacccccgcctacgagatcgagcacgtgatcccccagagctgctacttcgacgactccttcagcaacaaggtgatctgcgaggcggaggtcaacaagctcaagtccaacctgctcgggcacgagttcatcgtgaagcaccacggcgagatcgtggagctgccgttcgggaagaaggtccggatcttcaccgtggacgagtacgagcagttcgtgaaggacaactacagccgcacccggtccaagatgaagaagctgctcatggacgacatccccgaggagttcgtcacgcgccagctgaacgacagccggtacatctccaaggtggtcaagagcctgctctccaacatcgtgcgcgagaagggcgaggaggaggccatcagcaagaacgtgatcccctgcaccggcggggtgaccgaccggctgaagaaggactggggcatcaacgaggtctggaacaagatcatcctgccccgcttccagcggctcaacgagctgaccgggacgaacaagttcaccaccaagaacgtgggcatccaggagatcccgaccatgcccctggagctccagaaggggttcaacaagaagcgcatcgaccaccggcaccacgccatggacgccatcatcatcgcctgcgcgaaccgcaacatcatcaactacctgaacaacgagtccgccaccgccaaggccgagctgagccggtacgacctccagaagatgctgtgcgacaaggccaagacggacaacaacggcaactacaagtgggtgatccgcaagccctgggcgtccttcacccaggacacctacctggccctcgagaacatcatcgtcagcttcaagcagaacctgcgcgtgatcaacaaggccaccaaccggttcctgcactacaacgaggagggcaagaagatcttcgtgaagcaggggaagggcgacaactgggccatccgcaagtccatgcacaaggacacggtcttcggggaggtgaacctccggcgcatcaagaccgtggccctgaacgaggcgatgaagaacccccagagcatcgtcgtgaaggacttcaagcggaagctgctcgagctgtggaacctgggcttcgacgccaagcgcatcaagaagtacttcgaggacaaccgggagacctggagcgacatcaacctctccaagatcgaggtgtactacttcagcaaggacaccaaggaccgcttcttcgccacgcggaagccgctggacacctccttcgaccgcaagaagatcgagaacaacatcaccgacaccgggatccagaagatcctgctccggcacctggagctgaaggacaacaaccccgacatcgccttcagccccgacggcatcgacgagatgaaccgcaacatcatccagctcaacaacggcaagtaccaccagcccatcatcaagatccggtggtacgagcaggcggacaagttcgccgtcgggcagacgggcaacaagtccagcaagttcgtggaggccgccaaggggaccaacctgttcttcgccgtgtacgagtccaacatcctggacaagaagaccaacaccatcatcaagaagcgcaactacgcgacgatcccgctcaacgtcgccatcgagcggcagaagcagggcctgcccgtggcccccgaggacgagaacgggaacgaccccatcttcgtgctgagcccgaacgacctcgtctacctgcccaccgacgacgagctggccaacggcatcatcgcccagcccctcgaccgcggccggatctacaagatggtgtccagctccggggagcagtgcttcttcatcaagcacatcgtcgcgaacgtgctggtggacaagttcgagttcagccccctgaacaagatggagcgcgccctcaccggcgagatgatcaagatgatctgcatcccgatcaaggtcgaccggctggggaacgtgctggagtccagctccagctacaagaagtga

SEQ ID NO: 2256 - RNA, 4515 nt, synthetic construct
  misc_feature 1..4515: note = Cas9 variant
  source 1..4515: mol_type = other RNA
atgaagaacatcgtgggcctggacctcgggaccaacagcatcggctgggccgtcgtgaacgggtccgtgaacgacgacggcagcgagcagctggtcaagatccaggcctccgggagccgcatcatccccatggacgcggccatgatcggcgacttcaacaagggcaactccatcagccagaccgccgagcggacgcgcctgcgcggggtgcggcggctctccgagcgctacctgctgcggcgcgagcggctccaccgcatcctggacatcctgggcttcctcccgttccacttcgcccaggacctggaccggcacgggaagatcgtgaagggcaaggagcccaagctggcctggcgcaagaacgaggcggggcagttcgagttcatcttccaggacagcttcaaggagatgctcgaggacttcaagctgaaccaccccaacctgatcaccgacgacaagaaggtcccctacgactggaccatctactacctccggaagaagggcctgacctccaagatcagcaaggaggagctggcctggatcctcctgaacttcaaccagaagcgcggctactaccagctgcgcggggaggaggaggaggagaacaagaacaagctcgtggagttctacgccctgaaggtggtcgccgtggaggactccggcgagaagaaggggaaggacatctggtacaacgtgcacctggagaacggctgggtctaccggcggacgagcaacatgccgctcgactgggtgggcaagaccaaggagttcatcgtgaccaccgacctggagaaggacgggacgcccaagaaggacaaggagggcaacgtcaagcgctccttccgggcgcccaaggaggacgactggagcctggtgaagaagaagaccgaggccgacatcgaccagacccacaagaccgtgggggcctacatctacgacacgctcctgggcaacccctcccagaagatccgcgggcggctggtccgcaccatcgagcgcaagtactacaaggaggagctcaagcagatcctggagaagcagaaggagttccacctggagctccaggaccgggccctgtacgccgcgtgcatcgaggagctgtacccgatcaacgaggcccaccgcaacaacgtgggcaaccgggacttcacctacctcttcctggaggacatcctgttctaccagcgccccctcaagagcaagaagtccctgatcgacaactgcccctacgaggagaaccagggcctggacaaggagaccggggagatcaagagcttccccgtgaagtgcatcgccaagtcccaccccctcttccaggagttccggctgtggcagttcatcatcaacctgcgcatctaccggaaggacctcgcccaggacgtcgacgtgacgaacgagctgctgaagaccgaggaggactacgtggccctcttcgactggctgaacggcaagaaggagatcgaccagaaggcgttcctgaagtacccggtcttccgcctgaagaaggagatcgagaactaccggtggaactacgtgcaggacaagccctacccctgcaacgagacccgcagcctcatgctggcccggctggagaagtgcgacatcagcatcgagttcctcaccaaggagaacgaggaggccctgtggcacatcctgtactccgtcgaggacaagaacgagatcgtgaaggccctccagaagttcgccgacaagcacgacctgaacgcgagcttcgtggacgtcttccagaagttcccgcccttcaagaaggagtacgggtcctacagcgccaaggccatcaagaagctgctccccctgatgcgcatgggcaagtactggtccgagaacagcatcgacaaggggacgcgggcccgcatcgacaagatcatcaccggcgagtacgacgagaagatcgagaaccgggtgcgcgagaaggccatccacctggcggacgtgtccgacttcaagggcctccccctgtggctggtctgctacatcgtgtacgggcggcacagcgaggccaaggagatcatccagtggaagtccccggccgacatcgacagctacctccgctccttcaagcagcacagcctgcggaaccccatcgtggagcagatcatcatcgagaccctgcgcgtcgtgcgcgacatctggaagcaggtcggcaacatcgacgagatccacgtggagctcgggcgggagatgaagaaccccgccgacaagcgcaagaagatgacccagcagatgtccgagaacgagaacacgaacctgcggatcaagtacctgctcaccgagttcctgaaccccgagtacgaggtggagaacgtgcgcccgtacagcccctcccagcaggacatcctgcggatctacgaggagggcgtcctcaacagcgtgtccgacctgcccgaggagatcagcgacatcctgaagaagttcaccgagaccgacctcaagaagcgcccctcccggagcgagatcctgcgctacaagctgtggctcgagcagaagtaccggagcccgtacacgggggaggtgatccccctgggcaagctgttcacccccgcgtacgagatcgagcacgtcatcccgcagtcctgctacttcgacgacagcttctccaacaaggtgatctgcgaggccgaggtgaacaagctcaagagcaacctgctgggccacgagttcatcgtcaagcaccacggggagatcgtggagctccccttcggcaagaaggtgcgcatcttcaccgtcgacgagtacgagcagttcgtgaaggacaactactcccggacccgcagcaagatgaagaagctgctgatggacgacatccccgaggagttcgtgacgcggcagctcaacgactcccgctacatcagcaaggtcgtgaagtccctgctgagcaacatcgtgcgggagaagggggaggaggaggccatctccaagaacgtcatcccctgcaccggcggcgtgaccgaccgcctcaagaaggactgggggatcaacgaggtgtggaacaagatcatcctgccgcggttccagcgcctgaacgagctcaccggcacgaacaagttcaccaccaagaacgtcgggctgcaggagatccccaccatgcccctggagctccagaagggcttcaacaagaagcggatcgaccaccgccaccacgccatggacgccatcatcatcgcgtgcgccaaccggaacatcatcaactacctgaacaacgagagcgccaccgccaaggccgagctgtcccgctacgacctccagaagatgctgtgcgacaaggcgaagacggacaacaacgggaactacaagtgggtgatccgcaagccctgggccagcttcacccaggacacctacctggccctcgagaacatcatcgtgtccttcaagcagaacctgcgggtcatcaacaaggccaccaaccgcttcctgcactacaacgaggagggcaagaagatcttcgtgaagcagggcaagggggacaactgggccatccgcaagagcatgcacaaggacacggtgttcggcgaggtcaacctccggcggatcaagaccgtggcgctgaacgaggccatgaagaacccgcagtccatcgtggtcaaggacttcaagcgcaagctgctcgagctgtggaacctggggttcgacgccaagcggatcaagaagtacttcgaggacaaccgcgagacctggagcgacatcaacctcagcaagatcgaggtgtactacttctccaaggacaccaaggaccggttcttcgccacgcgcaagcccctggacaccagcttcgaccggaagaagatcgagaacaacatcaccgacaccggcatccagaagatcctgctccgccacctggagctgaaggacaacaaccccgacatcgcgttctcccccgacgggatcgacgagatgaaccggaacatcatccagctcaacaacggcaagtaccaccagccgatcatcaaggtgcgctggtacgagcaggccgacaagttcgccgtcggccagacggggaacaagttcagcaagttcgtggaggccgccaagggcaccaacctgttcttcgcggtgtacgagtccaacatcctggacaagaagaccaacaccatcatcaagaagcggaactacgccacgatccccctcaacgtcgccatcgagcgccagaagcaggggctgcccgtggcccccgaggacgagaacggcaacgacccgatcttcgtgctgagccccaacgacctcgtctacctgcccaccgacgacgagctggccaacgggatcatcgcgcagcccctcgaccggggccgcatctacaagatggtgtccagctccggcgagcagtgcttcttcatcaagcacatcgtcgccaacgtgctggtggacaagttcgagttcagcccgctgaacaagatggagcgggccctcaccggggagatgatcaagatgatctgcatccccatcaaggtcgaccgcctgggcaacgtgctggagtccagctccagccacaagaagtga

SEQ ID NO: 2257 - RNA, 4515 nt, synthetic construct
  misc_feature 1..4515: note = Cas9 variant
  source 1..4515: mol_type = other RNA
atgaagcgcatcctgggcctcgacctggggaccaacagcatcggctgggccctgatcgagaacgacttcaaccggaaggaggggaagatcgaggccctcggctcccgcatcatccccatgagccaggacatcctggggaagttcgactccggcgtgaccgtcagccagacggcggcccggaccaactaccgcggcatccggcgcctgtaccagcgggacaacctccgccgggagcgcctgcaccgggtgctgaacatcctcgggttcctgccgaagcactacgccgagtccatcgacttcgaggaccgcctgggccagttcaagcccgagaccgaggtgaagctcccctaccggaaggacagcgacgacaactaccacttcatcttccaggagtccttcaacgagatggtcgaggagttccagttcaagaaccccagcctgttctacaccaaggccaacggggagcagtccaagatcccgtacgactggacgctgtactacctccgcaagaaggccctgagcaagaagatctccaaggaggagctggcgtggatcctcctgaacttcaaccagaagcggggctactaccagctgcgcggggaggaggaggccgacagcaaggacaagctcgaggagtaccacgccctgaaggtgtccgacgtgcaggccaccgaggacaccaacgcgaagggcacctggtacaacgtcatcctggagaacggctggatctaccggcgccagagcaaggactccctcttcgactggaaggggaagacgcgggagttcatcgtgaccaccagcctggagaagggcggggccgtgaagatcgacaaggagggcaacgagaagcgctccttccgggccgtcgacagcgagaaggactggatcgccatcaagaagaagaccgagaacgacctggccaacgcgggcacgaccgtgggggtgtacatctacgagaccctcctgcgcaaccccgaccagaagatccgcggcaagctgatcaagaccatcgagcggaagtactacctcgaggagctgaaggccatcctggccaagcagatccaggagcacgccgagctccagaaccgctccctgtacaaggactgcatcgaggagctgtaccaggggaacgaggcccacaagaacaacatcaaggagaacggcttcgactacctcttcctggaggacatcatcttctaccagcggcccctcaagagcaagaagtccacgatcagcaactgcccctacgagagccgcgtcttcatcaaggacgggaagaaggagatccagccgatcaagtgcatctccaagagcaaccccatctaccaggagttccggctgtggcagttcatccacaacctgaagatctacgagaaggaggcgatcgacgacggcaagaccgtgatcaacaaggacgtgaccaccgagttcctgaacacgcaggaggcctacgccgccctcttcgagttcctgaacgacaaggccgagatctcccagaacgcgctgctcaagtacttcaagctgagcaccaacacccaccgctggaacaacgtcgaggacaagaagtacccctgcaacgagacccggtccgagttcatcaagcgcctgagcaagatggacggcatcgacctcgggaagacgctgtcccccgccttcgagaagtccctgtggcacatcatctacagcgtgaaggacaagaagcagtacgtgcgggccctggagaccttcgccatgaagaacggcctcgacatcaaccagttccgcgagaacttcgagaagttcaagccgtacgacagcgcctacggggcgtactccgagaaggccctgaagaaggtcctgcccctcatccggcgcggcacctactggaagaaggacgccatccccgccgcggtgcaggagcggatcgtgaacatcatgaagcgcatcgagagcgtcgacttcaacctggagaagatcgagaacttcgccgacgacgacatccccaagcagctgctcaagtccttcgccaaggggaaggacccgatgcagggcctgaacacctaccaggcctgctacgccgtgtacaaccggcacagcgaggtgtccgacatccagctgtggaagtcccccgaggacatcacgaagtacctcgacagcttcaagcagcacagcctgcgcaaccccatcgtcgagcaggtcgtgatggagaccctgcgggtggtgcgcgacatctggcagtactacggcaacggggcgaaggacttcttcagcgagatccacgtcgagctcggccgggagatgaagaacgacaagaagacccgcgagcgcatctccaagagcatcaccgagaacgagaacacgaacgagcggatcaagaacatcctgaaggagctgatgggggacgaggccctccagggcgacatccgcccctactccaaggggcaccaggacatcctgaagctgtacgaggagggcgtgttcgccaacgccccggagacctacaagaacatcaagatcgacgacatcgagaagatccggaagaacaacagcccctccaagagcgacatcgtgaagtacaagctctggctggagcagggctacatctccccctacaccgggagccccatcccgctgtcccgcctcttcaccacggactaccagatcgagcacatcatcccccggagccgctacttcgacgactccatgggcaacaagatcatctgcgagagcgccgtcaacgaggagaagaccaacaagaccgcgtacgagttcatcaaggagaacgccgggcggatcatcgacctgggccagggcaagcaggtccccctgttcgacctcgaggcctacgagtcccactgccgcgggtacttcaagggcaacaccaagaagctgaagttcctgctcagcgaggacatccccgaggggttcatcaaccggcagctgaacgactcccgctacatcagcaaggtggtgacctccctgctcagcaacgtggtgcgggaggagggcgagcaggaggccacgagcaagaacctggtcccgctggtggggaccatcacctccaagctcaagaaggactggggcctggaggccatctgggacgacctgatcgcgccccgcttcgagcggatgaaccagctcaccaagagcacggacttccgcaaggaggtgatcgacggccacgggaaccggtacttcatcaacaccgtccccgacgacatcaagaagggcttctccaagaagcgcatcgaccaccggcaccacgccctggacgccctggtgatcgcctgcaccaccaaggaccacgtgaactacatcacgagcctcaacacccagcgcaacaaccggtccctggtcagcaagctgcgcaagatcgaggagaagaccatcaaggacaagcggaccgggcagccgaagacgatcaagatcgcgaaggcctaccacaagccctggcccaacttcaccaaggagaccttcgagaagctctccaagaccgtggtgagcttcaagcagaaccagcgcatcatcaacaagacgaacaacaagacctggggctgggagaaggtcgacggggtgatgaagaaggtgctgaagaagcaggagaagcgcaactgggccatccggaagcccatccacaaggagacctactacggcaaggtcaagggcttcgactccccgaaggggaagatcaccacggccacccgcaagagcctgcgggagatcaccaacgagcgccagctcaacaccatcacggactccggcatcaagaagatcctgaacaaccacctgaagaccttcatcgacgagagcgggaagatcaacttcgagcccgccttcaaccaggacggcatcgacctcctgaacaagaacatccagcagctgaacgaggggaagaaccaccagcccatctacaaggtgcggatgtacacccacaacaccatgttctccgtgggcgacgagggcaacaagagcacgaagtacgtcatccccgagtccgggaccaacctcttcttcaacgtgtactgggacgaggagaacaacaagcgcaacttcgagaccgtgccgctgaaccgggtcatcgcgttccagaagcagaccagccacatcccccgcaaggaccggacggacgtgcccatcgacaacaccctgggccgcttcctcttcaccctgtcccccgacgacctggtgtacctcccgaccgacgaggagagcgagtccttcacgaccttcgagatcgacagcctgaacagcaagcaggtcgccaacatctacaagttcgtggacgggtccggcaccaccgggaacttcgtgcccgccgaggccgcccgggtcatcgcgaacatcaaggacaagaaggtgcgcagcaacttctgcaagcggaacaacctgtccgacaagcagctcatcaagaacgagttcggcctgggcagcccccagctgaagaaccagaactccctcgacgggcgccagatcaagagcatctgctggaagctggagatcaaccggctgggcaagatcatcaaggtgatcaagtga

SEQ ID NO: 2258 - RNA, 4515 nt, synthetic construct
  misc_feature 1..4515: note = Cas9 variant
  source 1..4515: mol_type = other RNA
atgaagaaggtgctgggcctcgacatcgggaccaacagcgtcggctgggccgtggtgaaccagaacgacaagggggagttcctgtccatcgagaagatcggcagccgcatcatccccatgtcccaggacgtcatggacaagttcggggccggccagaccgagagctccacggcgcagcggacccagtaccgcggcgtgcggcgcctgcgggagcgcagcctcctgcggcgcgagcggctgcaccgcgtgctccacatcctgcacttcctgccgcagcactacgacgccgccatcgggtggaacaagaaggagaacaagacctacggcaagttcctccccggggtcgaggtgaacatcccctgggtggccaccgaccagggccaccagttcatcttcatggactcctacgccgagatgctgaaggacctgaagcagcaccagccccacctcttcgagaagtccagcacgccggtccccctggactggaccatctactacctgcggaagaaggcgctcacccaggccatcagcaaggaggagctggcctggatcctgctcaacttcaaccagaagcgcgggtactaccagctgcggggcgaggaggtggaggacaacaccaagcgcgaggagttctacgccctgaaggtggtcaaggtggagctcgacaaggacaacacgtccgcgaagacctggtacaaggtgcacctggagaacggcttcatctacccctgccccagcgacaccccgatcgactcctgggtcgggatggtgaaggacttcatcgtgaccacgaccctggagaaggacggcagcgagaagcggaccgccgacggggagatcaagcgctccttccgggcccccaaggaggacgactggaccctcctgaagaagaagacggagagcgagctggagaagtccggcaagcaggtcggcgccttcatctacgacaccctcctgagcaaccccgaccagaagatcatcgggggcctgatcaagaccatcgagcgcaagtactacaagaaggagctcgagcagatcctggagacccagcagaagttcatcgccgagctgtccgacaagaagctgttccaggcgtgcgccgaggagctgtaccccctgaacgacagccaccgggagaacctcctggagcgcgacttcaagcacctgttcgtgcaggacatcatcttctaccaccggccgctcaagacgaagaagtccctgatcagcaactgcacctacgagtaccgcaccttctacaagaacggggagaagcagatcagccccatcaagtgcatcgccaagtccaaccccctgttccaggagttccgcgtgtggcagttcgtccagaacctccggatcctgcagcgccagcggagcgagggcgactccatcaagtacaacgtggacgtgaccgccgagttcctgaaggacgagaacgacatcgccaacctcttcacgtggctgaacgagcgcaaggtcatcaagcaggaccagctgctcaagagctacttcaagctgaaggtgaacaaggagaccaaggagctggactaccggtggaactacgtcgacgacaagaacaaggagtacccctgcaacgcgacccgcacccacatcctgtccttcctcgagaagtgcaaggaggagaagcggatcgaggacgaccgcttcgtgtacagcctgtggcacctcctctactccgtggtcgagccgatcgagctgcgcggggccctggccaagttcgccgagcgggagcacctccaccccagcttcgtggacgtgttcgcccagttcccgcccctggagaaggagtacggctcctacagcgagaaggcgatcaagcggctgctccccctgatgcgcatgggcgactactggcacgaggacaagatcgacgtcaagacgaagcagcggatccagcgcatcatcgacggggaggccgacgacgacatcacccaccggtcccgcgagaaggtggagaacctgcggagcatcaccgacttcaagggcctccccctgtggaaggccgggtacgtggtctacaaccgccactccgagagcggcgagctgaccaagtggaagacgccccacgagctctccaactacatccagaacgagttcaagcagtacagcctgcggaaccccatcgtggagcagatcgtgctggagaccctccgcgtcgtgcacgacctgtgggtgaagcacggggacttctccgagatccacctggagctcggccgcgacatcaagaacagcagcgacaagcggaagcgcatggccgagcggcagcaggagaacgagaactcccgccagcgggtcctggagatgctgatcgacctcaagaaggaggccgcgttcgccgacctgaacccgtacagcccctcccagcaggagaagctgcgcatcgtggaggacggcgtgctccggagcaacatcgagatccccaaggacatcgagaagatcaccaagtccgccaagcccaccagccgcgagctgacgaagtaccggctgtggctcgaccagaagtaccgctccccgtacaccgggcagcccatcagcctggcccagctgttcacctccaagtacgagatcgagcacgtcatcccccaggcgaagtacttcgacgacagcttcaccaacaaggtgatctgcgagtccgaggtgaacaaggagaagggcagcatgctcgcccacgagttcatcctgaagaacgggggctccaccgtcaacgtgggcgggcgccaggtgcaggtcctgaagaacgacgcctacgtggagctcatcaaccggctgtacggcaagaacaacccggtgaaggccaagaagctgctcgccgaggacatcgacgaggtcgtgggggacttcagcgagcggcagctgaacgacacgcgctacatctcccgggtggtccagaagctgctcagcaacatcgtgcgcgaggaggacgagcaggagtccaccagcaagcacgtgatcggctgcagcgggcaggtcaccaccgcgctgaagaaggactggggcctgaacgacatctggaacaagatcatccagccccggttcgagcgcctcaacgagatgacggccaccgaggactacggcgtgtggcagtcccccaaccacttccagatccgggtgcccgaggagatccagaaggggttcaccaagaagcgcatcgaccaccggcaccacgccatggacgccctggtcatcgcctgcgcgacccgcagccacatcaactacatctccaaccgcagcggccaggaccggaacgccaagttcgagacgacccgcaccgacctgcggtccaagctctgctacaaggagaacagctccgggaacaactacaactacatcttcaacaagccgtgggacaccttcacgcaggacgcccaccgcgccctggagaacatcgtggtgagccacaagcagaacctgcgggtcctcaccaagaccaacaactacacccagttcatcaacaaggacggcaagaaggacctgcagaagcaggtcaagggggaccacttcgccgtgcgcaagcccatgcaccaggagacgatctacggccgggtgtccatccgcagcatcaaggaggtggcgctgaagaaggccctcgagaactggaagcagatcgtggaccggaccctgaaggacaagatccgcgagctgatcggcgcctacgggaagtacgacgcccagaccatcctcaagtacttcaaggaccgggactacaagttcaacaacctgaagatcaaccgcgtcgaggtgtacgagtacgaccacaactgcgcggccgtgcggaagtccatcggcgacgacctgaccatcaagcagatcgagcgcatcacggacgagagcatccggaagatcctcatgaaccacctgtccaactacgacgacaacctgaaggaggccttcagccccgaggggctcatggagatgaacaagaacatcaaggagctgaacggcgggaagaaccaccagcccatctacaaggtccgcctgttcgaggacctcggctccaagttcccgctgggcgtgagccacaacaaccccgacaagtacgccatcgccgcgaaggggaccaacctgttcttcggcatctacgaggaccaggaggggaagcggatgttcgactccatccccctcaacatcgtgatcgaccgcctgaaggagaagaagtcccccgtcccggagacctacaacgagagcaagctgaagttccacctcagccccaacgacctggtgtacgtccccaccgacgaggagcagaagcagcccgagctggtggacgtggaccacctcagcgacgagcagaagggccgggtctacaaggccgtgtccttcacggggaaccgcgccttcttcgtgaaccaccgcgtcagcaaggtgatccacgactacgtggagttcggcaccaagaacaagatcgagaacgacgacgacaagcggtccctgaagcacatctgctggaagctgaaggtcaaccgcctcggcgagatcaccgacgtgaagcggtga

SEQ ID NO: 2259 - RNA, 4515 nt, synthetic construct
  misc_feature 1..4515: note = Cas9 variant
  source 1..4515: mol_type = other RNA
atgaagaacatcgtgggcctggacctcgggaccaacagcatcggctgggccgtcgtgaacgggtccgtgaacgacgacggcagcgagcagctggtcaagatccaggcctccgggagccgcatcatccccatggacgcggccatgatcggcgacttcaacaagggcaactccatcagccagaccgccgagcggacgcgcctgcgcggggtgcggcggctctccgagcgctacctgctgcggcgcgagcggctccaccgcatcctggacatcctgggcttcctcccgttccacttcgcccaggacctggaccggcacgggaagatcgtgaagggcaaggagcccaagctggcctggcgcaagaacgaggcggggcagttcgagttcatcttccaggacagcttcaaggagatgctcgaggacttcaagctgaactaccccaacctgatcaccgacgacaagaaggtcccctacgactggaccatctactacctccggaagaagggcctgacctccaagatcagcaaggaggagctggcctggatcctcctgaacttcaaccagaagcgcggctactaccagctgcgcggggaggaggaggaggagaacaaggacaagctcgtggagttctacgccctgaaggtggtcgccgtggaggactccggcgagaagaaggggaaggacatctggtacaacgtgcacctggagaacggctgggtctaccggcggacgagcaacatgtccctcgactgggtgggcaagaccaaggagttcatcgtgaccaccgacctggagaaggacgggacgccgaagaaggacaaggagggcaacgtcaagcgcagcttccgggcgcccaaggaggacgactggtccctggtgaagaagaagaccgaggccgacatcgaccagacccacaagaccgtgggggcctacatctacgacacgctcctgggcaaccccagccagaagatccgcgggcggctggtccgcaccatcgagcgcaagtactacaaggaggagctcaagctgatcctggagaagcagaaggagttccacctcgagctgcaggaccgggccctgtacgccgcgtgcatcgaggagctctaccccatcaacgaggcccaccgcaacaacgtgggcaaccgggacttcacctacctgttcctggaggacatcctcttctaccagcgcccgctgaagtccaagaagtccctgatcgacaactgcccctacgaggagaaccagggcctcgacaaggagaccggggagatcaagagcttccccgtgaagtgcatcgccaagagccaccccctgttccaggagttccggctgtggcagttcatcatcaacctccgcatctaccggaaggacctggcccaggacgtcgacgtgacgaacgagctgctcaagaccgaggaggactacgtggccctgttcgactggctgaacggcaagaaggagatcgaccagaaggcgttcctgaagtacccggtcttcgggctcaagaaggagatcgagaactaccgctggaactacgtgcaggacaagccctacccctgcaacgagacccggagcctgatgctggcccgcctcgagaagtgcgacatctccatcgagttcctgaccaaggagaacgaggaggccctgtggcacatcctctacagcgtcgaggacaagaacgagatcgtgaaggccctgcagaagttcgccgacaagcacgacctgaacgcgtccttcgtggacgtcttccagaagttcccgcccttcaagaaggagtacggcagctactccgccaaggccatcaagaagctcctgcccctgatgcggatggggaagtactggagcgagaactccatcgacaagggcacgcgcgagcggatcgacaagatcatcaccggcgagtacgacgagaagatcgagaaccgcgtgcgggagaaggccatccacctcgccgacgtgagcgacttcaaggggctgcccctgtggctcgtctgctacatcgtgtacggccgccactccgaggcgaaggagatcatccagtggaagtcccccgccgacatcgacagctacctgcggagcttcaagcagcactccctgcgcaacccgatcgtggagcagatcatcatcgagaccctccgggtcgtgcgcgacatctggaagcaggtcgggaacatcgacgagatccacgtggagctgggccgcgagatgaagaaccccgccgacaagcggaagaagatgacccagcagatgagcgagaacgagaacacgaacctgcgcatcaagtacctcctgaccgagttcctgaaccccgagtacgaggtggagaacgtgcggccctactccccgagccagcaggacatcctccgcatctacgaggagggggtcctgaactccgtgagcgacctgcccgaggagatctccgacatcctcaagaagttcaccgagaccgacctgaagaagcggcccagccgcagcgaggtgctgcggtacaagctctggctggagcagaagtaccgctccccctacacgggcgaggtcatcccgctgggcaagctgttcacccccgcctacgagatcgagcacgtgatcccccagagctactacttcgacgactccttcagcaacaaggtgatctgcgaggcggaggtcaacaagctcaagtccaacctgctcgggcacgagttcatcgtgaagcaccacggcgagatcgtggagctgccgttcgggaagaaggtccggatcttcaccgtggacgagtacgagcagttcgtgaaggacaactacagccgcacccggtccaagatgaagaagctgctcatggacgacatccccgaggagttcgtcacgcgccagctgaacgacagccggtacatctccaaggtggtcaagagcctgctctccaacatcgtgcgcgagaagggcgaggaggaggccatcagcaagaacgtgatcccctgcaccggcggggtgaccgaccggctgaagaaggactggggcatcaacgaggtctggaacaagatcatcctgccccgcttccagcggctcaacgagctgaccgggacgaacaagttcaccaccaagaacgtgggcatccaggagatcccgaccatgcccctggagctccagaaggggttcaacaagaagcgcatcgaccaccggcaccacgccatggacgccatcatcatcgcctgcgcgaaccgcaacatcatcaactacctgaacaacaagtccgccaccgccaaggccgagctgagccggtacgacctccagaagatgctgtgcgacaaggccaagacggacaacaacggcaactacaagtgggtgatccgcaagccctgggcgtccttcacccaggacacctacctggccctcgagaacatcatcgtcagcttcaagcagaacctgcgcgtgatcaacaaggccaccaaccggttcctgcactacaacgaggagggcaagaagatcttcgtgaagcaggggaagggcgacaactgggccatccgcaagtccatgcacaaggacacggtcttcggggaggtgaacctccggcgcatcaagaccgtggccctgaacgaggcgatgaagaacccccagagcatcgtcgtgaaggacttcaagcggaagctgctcgagctgtggaacctgggcttcgacgccaagcgcatcaagaagtacttcgaggacaaccgggagacctggagcgacatcaacctctccaagatcgaggtgtactacttcagcaaggacaccaaggaccgcttcttcgccacgcggaagccgctggacacctccttcgaccgcaagaagatcgagaacaacatcaccgacaccgggatccagaagatcctgctccggcacctggagctgaaggacaacaaccccgacatcgccttcagccccgacggcatcgacgagatgaaccgcaacatcatccagctcaacaacggcaagtaccaccagcccatcatcaagatccggtggtacgagcaggcggacaagttcgccgtcgggcagacgggcaacaagtccagcaagttcgtggaggccgccaaggggaccaacctgttcttcgccgtgtacgagtccaacatcctggacaagaagaccaacaccatcatcaagaagcgcaactacgcgacgatcccgctcaacgtcgccatcgagcggcagaagcagggcctgcccgtggcccccgaggacgagaacgggaacgaccccatcttcgtgctgagcccgaacgacctcgtctacctgcccaccgacgacgagctggccaacggcatcatcgcccagcccctcgaccgcggccggatctacaagatggtgtccagctccggggagcagtgcttcttcatcaagcacatcgtcgcgaacgtgctggtggacaagttcgagttcagccccctgaacaagatggagcgcgccctcaccggcgagatgatcaagatgatctgcatcccgatcaaggtcgaccggctggggaacgtgctggagtccagctccagctacaagaagtga

SEQ ID NO: 2260 - RNA, 4515 nt, synthetic construct
  misc_feature 1..4515: note = Cas9 variant
  source 1..4515: mol_type = other RNA
atgaagaacatcgtgggcctggacctcgggaccaacagcatcggctgggccgtcgtgaacgggtccgtgaacgacgacggcagcgagcagctggtcaagatccaggcctccgggagccgcatcatccccatggacgcggccatgatcggcgacttcaacaagggcaactccatcagccagaccgccgagcggacgcgcctgcgcggggtgcggcggctctccgagcgctacctgctgcggcgcgagcggctccaccgcatcctggacatcctgggcttcctcccgttccacttcgcccaggacctggaccggcacgggaagatcgtgaagggcaaggagcccaagctggcctggcgcaagaacgaggcggggcagttcgagttcatcttccaggacagcttcaaggagatgctcgaggacttcaagctgaaccaccccaacctgatcaccgacgacaagaaggtcccctacgactggaccatctactacctccggaagaagggcctgacctccaagatcagcaaggaggagctggcctggatcctcctgaacttcaaccagaagcgcggctactaccagctgcgcggggaggaggaggaggagaacaagaacaagctcgtggagttctacgccctgaaggtggtcgccgtggaggactccggcgagaagaaggggaaggacatctggtacaacgtgcacctggagaacggctgggtctaccggcggacgagcaacatgccgctcgactgggtgggcaagaccaaggagttcatcgtgaccaccgacctggagaaggacgggacgcccaagaaggacaaggagggcaacgtcaagcgctccttccgggcgcccaaggaggacgactggagcctgctcaagaagaagaccgaggccgacatcgaccagacccacaagaccgtgggggtgtacatctacgacacgctgctgggcaacccctcccagaagatccgcgggcggctcgtccgcaccatcgagcgcaagtactacaaggaggagctgaagcagatcctggagaagcagaaggagttccacctcgagctgcaggaccgggccctgtacgccgcctgcatcgaggagctctacccgatcaacgaggcgcaccgcaacaacgtgggcaaccgggacttcacctacctgttcctggaggacatcctcttctaccagcgccccctcaagagcaagaagtccctgatcgacaactgcccctacgaggagaaccagggcctcgacaaggagaccggggagatcaagagcttccccgtgaagtgcatcgccaagtcccacccgctgttccaggagttccggctgtggcagttcatcgtcaacctccgcatctaccggaaggacctggcccaggacgtggacgtgacgaacgagctgctcaagaccgaggaggactacgtcgccctgttcgactggctgaacggcaagaaggagatcgaccagaaggccttcctgaagtaccccgtgttcgggctcaagaaggagatcgagaactaccgctggaactacgtccaggacaagccctacccctgcaacgagacccggagcctgatgctggcgcgcctcgagaagtgcgacatcagcatcgagttcctgaccaaggagaacgaggaggccctgtggcacatcctctactccgtggaggacaagaacgagatcgtgaaggccctgcagaagttcgccgacaagcacgacctgaacgccagcttcgtcgacgtgttccagaagttcccgcccttcaagaaggagtacggctcctacagcgcgaaggccatcaagaagctcctgcccctgatgcggatggggaagtactggtccgagaacagcatcgacaagggcacgcgcgagcggatcgacaagatcatcaccggcgagtacgacgagaagatcgagaaccgcgtgcgggagaaggccatccacctcgccgacgtctccgacttcaaggggctgcccctgtggctcgtgtgctacatcgtgtacggccgccacagcgaggccaaggagatcacccagtggaagtccccggcggacatcgacagctacctgcggtccttcaagcagcacagcctgcgcaaccccatcgtcgagcagatcatcatcgagaccctccgggtggtgcgcgacatctggaagcaggtcgggaacatcgacgagatccacgtggagctgggccgcgagatgaagaaccccgccgacaagcggaagaagatgacgcagcagatgtccgagaacgagaacaccaacctgcgcatcaagtacctcctgaccgagttcctgaaccccgagtacgaggtggagaacgtccggccgtacagcccctcccagcaggacatcctccgcatctacgaggagggggtgctgaacagcgtgtccgacctgcccgaggagatcagcgacatcctcaagaagttcaccgagacggacctgaagaagcggccctcccgcagcgagatcctgcggtacaagctctggctggagcagaagtaccgcagcccgtacaccggcgaggtcatccccctgggcaagctgttcacccccgcctacgagatcgagcacgtgatcccgcagtcctgctacttcgacgacagcttctccaacaaggtgatctgcgaggccgaggtcaacaagctcaagagcaacctgctggggcacgagttcatcgtgaagcaccacggcgagatcgtggagctgcccttcgggaagaaggtccggatcttcaccgtggacgagtacgagcagttcgtgaaggacaactactcccgcacgcggagcaagatgaagaagctgctcatggacgacatccccgaggagttcgtcacccgccagctgaacgactcccggtacatcagcaaggtggtgaagtccctgctcagcaacatcgtccgcgagaagggcgaggaggaggcgatctccaagaacgtgatcccctgcaccggcggggtgaccgaccggctgaagaaggactggggcatcaacgaggtctggaacaagatcatcctgccgcgcttccagcggctcaacgagctgacggggaccaacaagttcaccaccaagaacgtgggcatccaggagatccccaccatgcccctggagctccagaaggggttcaacaagaagcgcatcgaccaccggcaccacgccatggacgccatcatcatcgcctgcgccaaccgcaacatcatcaactacctgaacaacgagagcgcgacggccaaggccgagctgtcccggtacgacctccagaagatgctgtgcgacaaggccaagaccgacaacaacggcaactacaagtgggtgatccgcaagccctgggccagcttcacccaggacacctacctggcgctcgagaacatcatcgtctccttcaagcagaacctgcgcgtgatcaacaaggccacgaaccggttcctgcactacaacgaggagggcaagaagatcttcgtgaagcaggggaagggcgacaactgggccatccgcaagagcatgcacaaggacaccgtcttcggggaggtgaacctccggcgcatcaagaccgtggccctgaacgaggccatgaagaacccgcagtccatcgtcgtgaaggacttcaagcggaagctgctcgagctgtggaacctgggcttcgacgcgaagcgcatcaagaagtacttcgaggacaaccgggagacctggagcgacatcaacctcagcaagatcgaggtgtactacttctccaaggacacgaaggaccgcttcttcgccacccggaagcccctggacaccagcttcgaccgcaagaagatcgagaacaacatcaccgacacggggatccagaagatcctgctccggcacctggagctgaaggacaacaaccccgacatcgccttctcccccgacggcatcgacgagatgaaccgcaacatcatccagctcaacaacggcaagtaccaccagccgatcatcaagatccggtggtacgagcaggccgacaagttcgcggtcgggcagaccggcaacaagttcagcaagttcgtggaggccgccaaggggaccaacctgttcttcgccgtgtacgagtccaacatcctggacaagaagaccaacacgatcatcaagaagcgcaactacgccaccatccccctcaacgtcgcgatcgagcggcagaagcagggcctgcccgtggcccccgaggacgagaacgggaacgacccgatcttcgtgctgagccccaacgacctcgtctacctgcccaccgacgacgagctggccaacggcatcatcgcccagcccctcgaccgcggccggatctacaagatggtgtcctgcaccgggaacgagggccacttcatcccggcccgcatcgcgaaccccatcctgcagacgatcgagctggggagcaacaacaaggcccagaaggcctggaccgacgagatgatcaaggagatctgcatgcccatcaaggtcgaccggctcggcaacgtgctggagtccagctccagctacaagaagtga

SEQ ID NO: 2261 - RNA, 4521 nt, synthetic construct
  misc_feature 1..4521: note = Cas9 variant
  source 1..4521: mol_type = other RNA
atgaagaccatcctgggcctcgacctggggcccaacagcatcggctgggccaaggtggaggtcgacgacgaggggaactacctgcgcaacatcaagctcggctcccggatcatcccgatgacccaggacatgctgggggacttcgacaagggcgtgaaggtgagccagacggccatccgcaccgacttccggggcaaccgccggctgatcgagcgccacctcctgcggcgcgagcggctgcaccgcgtcctccacgcgctgaagttcctgcccaagcactacgaggacgccatcgggtgggaccggaacgagcccgccacctacggcaagttcgtgaacaactccgagcccaagctcgcctgggagcgccaggaggacgggagcatgcggttcctgttcatggagtccttcaacgagatggtggccgacttcgcgcagaaccagccgagcctggtctccgacggcaagaagatccccctcgactggaccatctactacctgcgcaagaaggccctgacgcggcccatcaagaaggaggagctcgcctggatcctgctgaacttcaaccagaagcgcgggtactaccagctccggggcgaggaggaggaggacaacctgaccaagcgcaaggagtactacaagctgaaggtggtgggcgtcgaggccgacggggcgcccaagggcgggaagacctggtacaacatccacctcgagaacggctggaccgcccggtgccagagcaagatcccgctggacgactgggtgggcaaggtgaaggagtacatcgtcacgaccgagtacgaggacgacgggaagacccccaagtgcgacaaggagggcaaggtgaagcgctccttcaagagccccgagaaggacgactggcagctgatcaagacccggacggagaagttcatcgacgactccaacaagaccgtgggggccttcatctacgactacctcctggagaagcccttcgacaagatccgcggcaagtacatccgcaccatcgagcggaagtactacaagaacgagctgcgcgagatcctccgggagcagaccaagtaccacgaggggctgcacagcctggaggccctcaagatctgcgccgaggagctgtacaagaacaaccagcagcaccaggagtacctgctcaagaaggacatgacgttcctgctgctcaacgacctgatcttctaccagcgcccgctgaagtccaagaagtccctcatcgcggactgcccctacgaggtctacaagtacgacgacaagctgaccggcaagaagggccagaagaagatcaagtgcatcgccaagagcaacccctactaccaggagttccggctgtggcagttcatcgccaacctccgcctgttcagcgtgaccgacgggaaggaggtgaccgccgagtacctgaagacggaggaggactacgtccgcctcttctccttcctgaacgaccggaaggacatcaagcaggagaccttcctgcggagcttcctgaagctcaagaaggagtccatcggcagcgagaagatctaccccatccgctggaactacatcgaggacgccaacaagagctacccgtgcaacgcgacccggcacgagctgctgctcgccttcgaccgcgccgacatcccccgggagctgctggacgtggaggagcgcgagtaccggctctggcacctcctgtactccatcgaggccaaggaggagaccgagagcgccctccgcaagctgaaggcgaacaaggccttcggggacctgaacatcgacgacgccttcgtgaactccttcctcaagatcaagcccttcgagaaggagtacggcgcctacagcgagaaggccatcaagaagctgctggcggtcatgcggcgcgggtccctctggaaggaggccgacatctgcgaggccacgaagcagaacatcgccaagatcctgcagaacgacatcgacgagaagctgaagaagaagatcgaggcggccgtgagctccttcaacaagctcagcgacttccagggcctgcccacctggctggcctgctacgtggtctacggccggcactccgaggccgcccagatccagtgctggcagagcccggaggacctcaagacctacatcaacaagttcaagcagcactccctgcgcaaccccatcgtggagcagtgcctgctcgagaccctgcgcacggtctacgacatctggaaggacgcggggcagatcgacgagatccacatcgagctgggccggaacatgaagtccaccgccgagcagcgcgcccggaagaccaaggacatcctccgcaacgagaacaccaacctgcggatcaagaacctgctcgtggagctgaagaacgacgacaagatcgagaacgtgcgcccctacagccccagccagcaggagatcctgcggatctacgaggagggggccctccaggagctgtccaaggaggacgagatgttcgaggacatcagcaagatctccaagatggcccagccgagccccacggagctgtcccgctacaagctctggctggagcagaagtaccggagcccctacaccggccgcgtcatccccctgagcaagctgttcaccaccgcgtaccagatcgagcacatcatcccgcagtcccggtacttcgacgacagcttcaacaacaaggtgatctgcgagtccgaggtgaacagcctgaaggacaacatgctggggtacgagttcatcaaggagtgcggcggccgcatcgtccactgcacgctcctgggggacgtgaagatcttcaccaaggaggagtacaaggacttcgtgaccaagcactacatcgacaacacctacaagcgggacaagctgctcctggaggacatcccccaggagttctccgcccgccagctgaacgacagccggtacatctccaagatggtccagaccgtgctcagcaacatcgtgcgcgccgagaacgagcaggaggccacgtccaagttcgtcgtgagctgcaacggcgccatcaccaaccggctgaagaaggactgggggctgaacgacgtgtggtccagcatcgtctgcccccgcttcaagcggctcaacgagatcaccaagaccaacgcgttcggccactgggaggacaaggccggcaagcacgtgttccagacgaccgtgccgctggagctgcagcgcgggttctccaagaagcggatcgaccaccgccaccacgccatggacgccctcgtcatcgcgtgcgccagccgcaacatcgtgaactacctgaacaacgagtccgccaacagccccgagaagcgggaggacctgcgcaagaagctctgcgacgagaagcggaagatccgcaagccctggaagaccttcacccaggacgcccgggaggccctgtccgacgtggtcgtgagcttcaagaactacgtgcgcgtcatcaacaaggcgacgaactactacgagcactacagctccagcggcaacaaggtgatgatctcccagaaggggaacgacatgtgggccatccggaagcccctgcacaaggagagcgtgttcggccgcgtcaacctctgccggaaggtgatcgtgtccctgaagaaggccctggagaacatcccggccatctgcgacaagaccctccgcgactacatcaacgccctggtcgagaagcacttcaacacccggcagctgctcgcgcacttcaagagcatcaactaccgcctgaaccggcagtgcgtggagaaggtggaggtctggcagttctccgacgagaagatcgagatggtggcccgccgcaagagcctggacacctccttcgacgacaagcagatcagctccatcacggacaccgggatccagaagatcctcctgaactacctgcagaccaaggacggcaacgccgagatcgccttcacccccgagggcatcgaggagatgaacaagaacatcagcctctacaacgacgggaaggcccaccagcccatcctgaaggtgcgggtcgcgacgcccaagggcatgaagtacccggtggggcagaccggcaacaaggccaccaagttcgtggtcgccgagaaggggaccaacctgtacttcgccatctacgagaacgagctcggcgtgcggtcctacgacacgatccccctgaacatcgtggtcgagcgcctgaaggagggcctcagccccgtgccccaggcgaacgaggccgacatcccgctgaagttctacctgtcccccaacgacctcgtgtacgtccccaccaaggagaacgaggacgagctgtgccgggaccgcatctacaagttcgtggacagctccgggaccaccgccaacttcgtgccccacacgagcgccaacaccatctacaacgtcgacaaggagtacgccgagaagtgctgcaacggcgcggtgttcctgaacgagtacgggctcggctccccgcagagcaagaaccagcgcgccctgaccggggagatgatcaaggagatctgctggaagctgaaggtggaccggctcggcaacatcatcaaggtcatcaagtga

SEQ ID NO: 2262 - RNA, 4530 nt, synthetic construct
  misc_feature 1..4530: note = Cas9 variant
  source 1..4530: mol_type = other RNA
atgaagaacatcgtgggcctggacctcgggaccaacagcatcggctgggccgtcgtgaacgggtccgtgaacgacgacggcagcgagcagctggtcaagatccaggcctccgggagccgcatcatccccatggacgcggccatgatcggcgacttcaacaagggcaactccatcagccagaccgccgagcggacgcgcctgcgcggggtgcggcggctctccgagcgctacctgctgcggcgcgagcggctccaccgcatcctggacatcctgggcttcctcccgttccacttcgcccaggacctggaccggcacgggaagatcgtgaagggcaaggagcccaagctggcctggcgcaagaacgaggcggggcagttcgagttcatcttccaggacagcttcaaggagatgctcgaggacttcaagctgaaccaccccaacctgatcaccgacgacaagaaggtcccctacgactggaccatctactacctccggaagaagggcctgacctccaagatcagcaaggaggagctggcctggatcctcctgaacttcaaccagaagcgcggctactaccagctgcgcggggaggaggagaagaagaacgacaacgtgatgatcatcaactccaaggtgatcgacgtcgtgaaggccgagaaggacaagaagtacgagaagtactggtacaacgtgctcctggagaacggcctgctctaccgggccgcgttctacaacgacatcagcttctggaaggggcacacgaaggagttcgtcctgaagaccatcaagctgaagtccggcggcaccaagcaggagctcagcttcctgccgtccttcgacgagatcgagaagatggagaagaagcagaaggacaagatgtacttcaagatcaagctgaagaccgaggccgacatcgaccaggcccacaagacggtggggacctacatctacgacaccctcctgggcaaccccagccagaagatccgggggcgcctggtgcggaccatcgagcgcaagtactacaaggaggagctcaagctgatcctggacaagcagaaggagttccaccccgagctccaggaccgggccctgtacgccgcgtgcatcgaggagctgtaccccatcaacgaggcccaccgcaacaacgtcggcaaccgcgacttcacgtacctcttcctggaggacatcctgttctaccagcggccgctcaagtccaagaagtccctgatcgacaactgcccctacgaggagaaccaggggctggacaaggagaccggcgagatcaagagcttccccgtgaagtgcatcgccaagagccaccccctcttccaggagttccgcctgtggcagttcatcgtgaacctgcggatctaccgcaaggacctcgcccaggacgtcgacgtgaccaacgagctgctgaagaccgaggaggactacgtggccctgttcgactggctcaacggcaagaaggagatcgaccagaaggcgttcctgaagtacccggtcttcgggctgaagaaggagatcgagaactaccggtggaactacgtgcaggacaagccctacccctgcaacgagacgcgcctcctgatgctggcccggctcgagaagtgcgacatcagcatcgagttcctgaccaaggagaacgaggaggccctgtggcacatcctctactccgtggaggacaagaacgagatcgtcaaggccctgcagaagttcgccgacaagcacgacctgaacgcgagcttcgtggacgtcttccgcaagttcccgcccttcaagaaggagtacggctcctacagcgccaaggccatcaagaagctcctgcccctgatgcggatggggaagtactggtccgaggacagcatcgacaagggcacccgcaagcggatggacaagatcatcaccggggagtacgacgagaagatcgagaaccgcgtgcgggagaaggtgatccacctcgccgacgtctccgacttccgcggcctgcccctgtggctcgtgtgctacatcgtgtacggccggcacagcgaggccaaggagatcacgcagtggaagtcccccgcggacatcgacagctacctgaagtccttcaagcagcacagcctgcgcaacccgatcgtcgagcagatcatcatcgagaccctccgggtggtgcgcgacatctggaagcaggtcgggaacatcgacgagatccacgtggagctgggccgggagatgaagaaccccgccgacaagcgcaagaagatgacccagcagatgtccgagaacgagaacaccaacctgcgcatcaagtacctcctgacggagttcctgaaccccgagtacgaggtggagaacgtccggccctacagcccgtcccagcaggacatcctccgcatctacgaggagggggtgctgaacagcgtgtccgacctgcccgaggagatcagcgacatcctcaagaagttcaccgagaccgacctgaagaagcggccctcccgcagcgagatcctgcggtacaagctctggctggagcagaagtaccgcagcccctacaccggcgaggtcatcccgctggggaagctgttcacgcccgcctacgagatcgagcacgtgatcccccagtcctgctacttcgacgacagcttctccaacaaggtgatctgcgaggccgaggtcaacaagctcaagagcaacctgctcggccacgagttcatcgtgaagcaccacggcgagatcgtggagctgccgttcgggaagaaggtccggatcttcaccgtggacgagtacgagcagttcgtgaaggacaactactcccgcacccggggcaagatgaagaagctgctcatggacgacatccccgaggagttcgtcgcgcgccagctgaacgacagccggtacatctccaaggtggtcaagagcctgctctccaacatcgtgcgcgagaagggggaggaggaggccatcagcaagaacgtgatcccctgcaccggcggcgtgacggaccggctgaagaaggactgggggatcaacgaggtctggaacaagatcatcctgccccgcttccagcggctcaacgagctgaccggcaccaacaagttcaccacgaagaacgtggggatccaggagatcccgaccatgcccctggagctccagaagggcttcaacaagaagcgcatcgaccaccggcaccacgccatggacgccatcatcatcgcctgcgcgaaccgcaacatcatcaactacctgaacaacgagtccgccaccgccaaggccgagctgagccggtacgacctccagaagctgctgtgcgacaaggccaagaccgacaacaacgggaactacaagtgggtgatccgcaagccctgggcgtccttcacccaggacacgtacctcgccctggagaacatcatcgtcagcttcaagcagaacctgcgggtgatcaacaaggccaccaaccgcttcctccactacaacgaggagggcaagaagatcttcgtgaagcagggcaagggggacaactgggccatccgcaagtccatgcacaaggacaccgtcttcggcgaggtgaacctgcggcgcatcaagaccgtggccctgaacgaggcgatgaagaacccccagagcatcgtcgtgaaggacttcaagcggaagctcctggagctgtggaacctcgggttcgacgccaagcgcatcaagaagtacttcgaggacaaccgggagacgtggtccgacatcaacctgagcaagatcgaggtgtactacttcagcaaggacaccaaggaccgcttcttcgccacccggaagccgctggacacctccttcgaccgcaagaagatcgagaacaacatcacggacaccggcatccagaagatcctcctgcggcacctggagctcaaggacaacaaccccgacatcgccttcagccccgacgggatcgacgagatgaaccgcaacatcatccagctgaacaacggcaagtaccaccagcccatcatcaagatccggtggtacgagcaggcggacaagttcgccgtcggccagaccgggaacaagttctccaagttcgtggaggccgccaagggcaccaacctgttcttcgccgtgtacgagagcaacatcctcgacaagaagacgaacaccatcatcaagaagcgcaactacgcgaccatcccgctgaacgtcgccatcgagcggcagaagcaggggctgcccgtggcccccgaggacgagaacggcaacgaccccatcttcgtgctctccccgaacgacctggtctacctgcccaccgacgacgagctcgccaacgggatcatcgcccagcccctggaccgcggccggatctacaagatggtgagctgcacgggcaacgaggggcacttcatccccgcgcgcatcgccaacccgatcctgcagaccatcgagctcggctccaacaacaaggcccagaaggcctggaccgacgagatgatcaaggagatctgcatgcccatcaaggtggaccggctggggaacgtcctggagagctccagctcctacaagaagtga

SEQ ID NO: 2263 - RNA, 4530 nt, synthetic construct
  misc_feature 1..4530: note = Cas9 variant
  source 1..4530: mol_type = other RNA
atgaagcgcatcctgggcctcgacctggggaccaacagcatcggctggtccctgatcgagcacgacttcaagaacaagcaggggcagatcgagggcctcggggtgcggatcatccccatgagccaggagatcctgggcaagttcgacgccggccagtccatcagccagaccgccgaccgcacgaagtaccgcggggtccggcggctgtaccagcgcgacaacctccggcgcgagcggctgcaccgcgtgctgaagatcctcgacttcctgccgaagcactactccgagagcatcgacttccaggacaaggtgggccagttcaagcccaagcaggaggtcaagctgaactaccggaagaacgagaagaacaagcacgagttcgtgttcatgaactccttcatcgagatggtgagcgagttcaagaacgcgcagcccgagctgttctacaacaaggggaacggcgaggagaccaagatcccctacgactggaccctgtactacctgcgcaagaaggccctcacccagcagatcacgaaggaggagctggcctggctgatcctcaacttcaaccagaagcgggggtactaccagctgcgcggcgaggacatcgacgaggacaagaacaagaagtacatgcagctgaaggtcaacaacctcatcgactccggcgccaaggtgaaggggaaggtgctgtacaacgtcatcttcgacaacggctggaagtacgagaagcagatcgtgaacaaggacgagtgggaggggcggaccaaggagttcatcatcaccaccaagacgctgaagaacggcaacatcaagcgcacctacaaggccgtggacagcgagatcgactgggcggccatcaaggccaagaccgagcaggacatcaacaaggccaacaagaccgtcggcgagtacatctacgagtccctcctggacaacccgagccagaagatccgggggaagctggtgaagacgatcgagcgcaagttctacaaggaggagttcgagaagctcctgtccaagcagatcgagctgcagcccgagctgttcaacgagagcctctacaaggcgtgcatcaaggagctgtacccccggaacgagaaccaccagtccaacaacaagaagcagggcttcgagtacctcttcaccgaggacatcatcttctaccagcgccccctcaagagccagaagtccaacatcagcgggtgccagttcgagcacaagatctacaagcagaagaacaagaagaccggcaagctggagctcatcaaggagccgatcaagaccatctcccggagccaccccctgttccaggagttccgcatctggcagtggctgcagaacctcaagatctacaacaaggagaagatcgagaacgggaagctggaggacgtgacgacccagctgctccccaacaacgaggcctacgtcaccctgttcgacttcctgaacaccaagaaggagctcgagcagaagcagttcatcgagtacttcgtgaagaagaagctgatcgacaagaaggagaaggagcacttccgctggaacttcgtggaggacaagaagtaccccttcagcgagacgcgggcccagttcctgtcccgcctcgccaaggtcaagggcatcaagaacaccgaggacttcctgaacaagaacacccaggtgggcagcaaggagaactccccgttcatcaagcggatcgagcagctgtggcacatcatctacagcgtgtccgacctgaaggagtacgagaaggccctcgagaagttcgcggagaagcacaacctggagaaggacagcttcctgaagaacttcaagaagttcccgcccttcgtctccgactacgccagctactccaagaaggccatcagcaagctcctgcccatcatgcgcatggggaagtactggtccgagagcgccgtgcccacccaggtgaaggagcggtccctgagcatcatggagcgcgtcaaggtgctccccctgaaggagggctactccgacaaggacctggccgacctcctgagccgggtctccgacgacgacatccccaagcagctgatcaagagcttcatctccttcaaggacaagaaccccctcaaggggctgaacacgtaccaggcgaactacctggtgtacggccgccacagcgagaccggggacatccagcactggaagaccccggaggacatcgaccggtacctcaacaacttcaagcagcacagcctgcgcaaccccatcgtggagcaggtcgtgatggagaccctgcgggtggtccgcgacatctgggagcactacggcaacaacgagaaggacttcttcaaggagatccacgtggagctcggccgggagatgaagtcccccgccgggaagcgcgagaagctgagccagcggaacacggagaacgagaacaccaaccaccgcatccgggaggtgctgaaggagctcatgaacgacgcctccgtcgagggcggggtgcgcgactacagcccctcccagcaggagatcctgaagctgtacgaggagggcatctaccagaacccgaacaccaactacctcaaggtggacgaggacgagatcctgaagatccggaagaagaacaaccccacccagaaggagatccagcgctacaagctgtggctcgagcaggggtacatcagcccctacacgggcaagatcatccccctgaccaagctgttcacccacgagtaccagatcgagcacatcatcccgcagtcccgctactacgacaacagcctcggcaacaagatcatctgcgagtccgaggtcaacgaggacaaggacaacaagaccgcctacgagtacctgaaggtggagaaggggagcatcgtgttcggccacaagctgctcaacctggacgagtacgaggcccacgtcaacaagtacttcaagaagaacaagacgaagctgaagaacctcctgtccgaggacatccccgaggggttcatcaaccggcagctgaacgacagccgctacatctccaagctcgtgaagggcctgctgagcaacatcgtgcgggagaacggcgagcaggaggcgacctccaagaacctcatccccgtcaccggggtggtgaccagcaagctgaagcaggactggggcctgaacgacaagtggaacgagatcatcgccccgcgcttcaagcggctcaacaagctgaccaactccaacgacttcgggttctgggacaacgacatcaacgccttccgcatccaggtccccgacagcctgatcaagggcttcagcaagaagcggatcgaccaccgccaccacgccctcgacgccctggtggtggcgtgcacgtcccggaaccacacccactacctgagcgccctcaacgccgagaacaagaactactccctgcgcgacaagctggtcatcaagaacgagaacggggactacaccaagaccttccagatcccctggcagggcttcacgatcgaggccaagaacaacctcgagaagaccgtggtgagcttcaagaagaacctgcgggtcatcaacaagaccaacaacaagttctggtcctacaaggacgagaacggcaacctgaacctcgggaaggacggcaagcccaagaagaagctgcgcaagcagaccaaggggtacaactgggcgatccggaagccgctgcacaaggagacggtgagcggcatctacaacatcaacgcccccaagaacaagatcgccacctccgtgcgcaccctcctgaccgagatcaagaacgagaagcacctggccaagatcacggacctccggatccgcgagaccatcctgcccaaccacctgaagcactacctcaacaacaagggggaggccaacttcagcgaggcgttctcccagggcggcatcgaggacctgaacaagaagatcaccaccctgaacgaggggaagaagcaccagcccatctaccgggtcaagatcttcgaggtgggcagcaagttctccatcagcgaggacgagaactccgccaagagcaagaagtacgtggaggccgccaaggggacgaacctcttcttcgccatctacctggacgaggagaacaagaagcgcaactacgagaccatcccgctgaacgaggtcatcacccaccagaagcaggtcgcgggcttccccaagtccgagcggctcagcgtgcagcccgactcccagaaggggaccttcctgttcacgctgagccccaacgacctcgtgtacgtgccgaacaacgaggagctggagaaccgcgacctgttcaacctcggcaacctgaacgtggagcagatctcccggatctacaagttcaccgacagcagcgacaagacctgcaacttcatccccttccaggtctccaagctgatcttcaacctcaagaagaaggagcagaagaagctggacgtggacttcatcatccagaacgagttcggcctggggagcccccagtccaagaaccagaagtccatcgacgacgtgatgatcaaggagaagtgcatcaagctcaagatcgaccgcctgggcaacatcagcaaggcctga

SEQ ID NO: 2264 - RNA, 4530 nt, synthetic construct
  misc_feature 1..4530: note = Cas9 variant
  source 1..4530: mol_type = other RNA
atgaagaccatcctgggcctcgacctggggaccaacagcgtgggctgggccgtcatcaactccgtgatcaaggagcaggccgagcgcatctggatcgagatggcggggagccggatcatccccatggacgccgccgtgctgggcgacttcgacaaggggaactccatcagccagacgtccgagcgcacccggctccgcggcgtccggcgcctgcgggagcgccagctgctccggcgcgagcggctgcacaaggtgctgaacatcctcggcttcctgccgaaccactacctggagtacatcgacttcgagaagcaccccgggaagttcctcagcgacgccgagcccaagctgccctgggtgaaggacgagcagggcaagtacaccttcctgttccaggccgcgttcgacgagatgctcgccgacttcgccatccaccagccgtccctggtcagcggggacaagaagatcccctacgactggaccatctactacctgcgcaagaaggccctcacggagatgatctccaaggaggagctggcgtggatcctgctcaacttcaaccagaagcggggctactaccagctgcgcggggaggaggaggaggacaacgccggcaagagcgtggagttctacgccctgaaggtgctcaccgtcgaggccaccgacgagaagaagggccgggacgtgtggtacaacgtgcacctggagaacgggtggatctaccgccggtccagctccgtccccctggactgggagggccagatcaaggagttcatcgtgaccacggacctcaaccccgacagcaccccgaagctggacaagtacggggaggtgaagcgctccttccgggcccccaaggaggacgactggatgctgatcaagaagcgcaccgaggcggacatcgccaacacccacaagacggtcggcgcctacatctacgacaccctcctgcagaagccccagcagaagatcatcggcaagctggtgaagaccgtggagcggaagctctaccgcgacgagctgagcctgatcctccagaagcagtgcgccttccacgccgagctgcaggaccgcaccctgtacgcgcggtgcgtcgaggccctctaccccaacaacgaggtgcagcgccggaacatcgccaaccgcgacttcgtgtacctgctgatggacgacgtcctcttctaccagcggccgctgaagacgaagaagtccctgatcgccaactgcccctacgaggagaacgagtacgtggaccgcgagaccggggagatcaagaaggcgcccctcaagtgcatcgccaagagccaccccctgttccaggagttccggctgtggaacttcctctccaacatccgcatctaccagaaggagaaggagatcaacggcaccctgcacctggacgtggacgtcaccgccgagttcctgaagacggaggacgactacgtggccctcttcgactggctgaacagccggaaggagatcgagcagaagaccttcctgaagtacccgaagttcgggctcaagaaggagatcagcaactaccgctggaactacgtcgaggacaagcagtacccctgcaacgagacccggcacgccatcctgtcccgcctggagaaggccaacgtgtgcatcgacttcctcagcaacgagaaggaggtggcgctgtggcacatcctgtactccgtcagcgacaagcaggagatcgagaaggccctccggaccttcgccgccaagaacggcctggacgagtccttcgtggaggcgttcaagaagttcccgcccttcaagagcgagtacggggcctactccgccaaggccatcaagaagctgctccccctgatgcgctgcggcaagtactgggacgtgagctccatcgacgacacgaccaaggagcggatcaagaagatcgtcgccggcgagtacgacgagcgcatcgcggtgaaggtgcgggacaaggtcatgaacctgagcgacatctcctgcttcaagcgcctccccctgtggctggcctgctacatcgtgtacaaccggcacagcgaggacaaggaggccgtgaagtgggagtcccccgccgacatcgacgcctacctcgcgagcttcaagcagcactccctgcgcaaccccatcgtcgagcaggtcatcaccgagaccctgcgcgtggtgcgggacatctggaagcaggtcgggcgcatcgacgagatccacatcgagctcggccgggagatgaagaacccggccgacaagcgcaagcggatgacggcccagatcctggagaacgagaacgccaacctgcgcatcaaggccctcctggcggagttcatgaaccccgagtacgagatcgagaacgtgcggccctacagcccctcccagcaggagatcctgcgcatctacgaggacatggtgctccacgccgaggaccagctgccggaggagatcgacgccatcctgaagaagttcaacagctccaaggtgcccaccaagagcgagttcctccggtacaagctgtggctggagcagaagtaccgcagcccctacaccggggagctcatcccgctgggcaagctgttcaccgccgcgtacgagatcgagcacgtgatcccccagtcccggtacttcgacgacagcttctccaacaaggtcatctgcgagagcgccgtgaacaagctcaaggacaaccagctggggtacgagttcatcaagaaccaccacggccagaaggtggaggtcggcttcgggaagtccgtggagatcttcagcgtggactcctacgagcgcttcgtcaaggagcagtacgccaagagcgccgtgaagatgaagaagatgctgatggacgacatccccgagcagttcatcgagcggcagctcaacgactcccgctacatcagcaaggtgatcaagggcctgctgtccaacatcgtccgggagaagaacgacagcggggagtacgagcccgaggccgtgtccaagaacatcgtggtctgcacgggcagcgtgaccgaccgcctcaagcgggactgggggatgaacgacgtgtggaactccatcgtctacccgcgcttcgagcggctgaacagcctgaccgacacccagtccttcggccactgggagaacaagagcggcaagaaggtgttccagacggagctccccctggagtaccagaaggggttcagcaagaagcgcatcgaccaccggcaccacgcgatggacgccatcgtgatcgcctgcgccacccgcaaccacgtcaactacctgtccaacgagagcgcctcccgcaacgcgaagatcagccggtacgacctccagcgcctgctgtgcgacaagtcccggaccgacgacaacggcaactacaagtgggtgatcaagaagccctgggacaccttcacccaggacgcccgcgaggtgctcagcaagatcgtcgtgtccctgaagcagaacctgcggatcatcaacaagacgaccaacgtgtaccgccacctcgacgccaccgggaaccgggtctacgagaagcagaagaccggcgacagctgggccatccgcaagcccatgcacaaggacacggtgttcggcgccgtgaacctgcggaaggtcaaggtggtgcgcctgtccgtcgcgctcgacgccccgaccatgatcgtggacaagcgggtcaagaacaaggtgttcgagctgctgagctacaagtacgacaagaagcgcatcgagaagtacttcaaggagaacgccgtgctctggaaggagctggacctggcccgggtcgcggtgtactacttcaccgaggccaccacggagcccctcgtggccgtccgcaagcccctggactccaccttcaacgagaagaagatcaaggagagcgtgaccgacaccgggatccagaagatcctgctcaaccacctgtgcacgaaggagggcaagcccgacctggccttctccgccgaggggatcgaggagatgaaccggaacctcctgcagctgaacaacggcaagcgccaccagccgatctacaaggtgcgggtctacgagccccgcgggaacaagttcagcgtgggcgtgctcggcaacaaggggaccaagtgggtcgaggcggccaagggcaccaacctgttcttcgccatctacatcaccgaggacgggaagcggacgtacgagaccatccccctgaacatggtgatcgagcgcgagaagcagggcctcgcccccgtgccggacaagaacgagaagggggacaagctgctgttctggctctcccccaacgacctggtctacctgcccaccgaggaggagctcgagttcggccgcatcaacgagcccatcgaccggggccgcatctacaagatggtgagctccagcgggaaccagtgcttcttcatcccgcagtccatcagcaacgccatcatccccaccaaggagctgggcgcgaacaacaaggccgagcggagctgggacggggccatgatcaagaacatctgcatccccgtgaaggtcgaccgcctgggccggatcatcgaggtgaagtaccgcatcaacgagtga

SEQ ID NO: 2265 - RNA, 4530 nt, synthetic construct
  misc_feature 1..4530: note = Cas9 variant
  source 1..4530: mol_type = other RNA
atgaagaccatcctgggcctcgacctggggaccaacagcgtgggctgggccgtcatcaactccgtgatcaaggagcaggccgagcgcatctggatcgagatggcggggagccggatcatccccatggacgccgccgtgctgggcgacttcgacaaggggaactccatcagccagacgtccgagcgcacccggctccgcggcgcccggcgcctgcgggagcgccagctgctccggcgcgagcggctgcacaaggtcctgaacatcctcggcttcctgccgaaccactacctggagtacatcgacttcgagaagcaccccgggaagttcctcgccgacgcggagcccaagctggcctgggtgaaggacgagcagggcaagtacaccttcctgttccaggccgccttcgacgagatgctcgcggacttcgccatccaccagcccagcctggtgtccggggacaagaagatcccgtacgactggaccatctactacctgcgcaagaaggccctcacggagatgatcagcaaggaggagctggcctggatcctgctcaacttcaaccagaagcggggctactaccagctgcgcggggaggaggaggaggacaacgccggcaagtccgtcgagttctacgcgctgaaggtgctcaccgtggaggccaccgacgagaagaagggccgggacgtctggtacaacgtgcacctggagaacgggtggatctaccgccggagctccagcgtgcccctggactgggagggccaggtcaaggagttcatcgtgaccacggacctcaaccccgacgggacccccaagctggacaagtacggcgaggtgaagcgctccttccgggccccgaaggaggacgactggatgctgatcaagaagcgcaccgaggccgacatcgccaacacccacaagacggtcggcgcgtacatctacgacaccctcctgcagaagccccagcagaagatcatcgggaagctggtgaagaccgtggagcggaagctctaccgcgacgagctgagcctgatcctccagaagcagtgcgccttccacgccgagctgcaggaccgcgccctgtacgcccggtgcgtcgaggcgctctacccctccaacgaggtgcgccggaagaacatcgccaaccgcgacttcgtgtacctgctgatggacgacatcctcttctaccagcggcccctgaagaccaagaagtccctgatcgccaactgcccgtacgaggagaacgagtacgtcgaccgcgagacgggcgagatcaagaagacgcccctcaagtgcatcgccaagagccaccccctgttccaggagttccggctgtggaacttcctcagcaacatccgcatctaccagaaggagaaggagatcaacgggaccctgcacctggacgtggacgtgaccgccgagttcctgaagaccgaggacgactacgtcgccctcttcgactggctgaactcccggaaggagatcgagcagaagaccttcctgaagtaccccaagttcggcctcaagaaggagatcagcaactaccgctggaactacgtggaggacaagcagtacccgtgcaacgagacccggcacgcgatcctgagctccctggagaaggccaacgtctgcatcgacttcctcagcaacgagaaggaggtggccctgtggcacatcctgtactccgtgagcgacaagcaggagatcgagaaggcgctccgcaccttcgccgccaagaacgggctggacgagtccttcgtcgaggccttcaagaagttcccgcccttcaagagcgagtacggcgcctactccgcgaaggccatcaagaagatgctgcccctcatgcggtgcggcaagtactgggacgtgagctccatcgacgacacgaccaaggagcgcatcaagaagatcgtgaccggggagtacgacgagcggatcagcgtcaaggtgcgcgacaaggtgatgaacctgtccgacatcagctgcttccggcgcctgcccctctggctggcctgctacatcgtctacaaccggcactccgaggacaaggaggccgtgaagtgggagagccccgccgacatcgacgcgtacctggcctccttcaagcagcacagcctccgcaaccccatcgtggagcaggtcatcaccgagacgctgcgcgtggtgcgggacatctggaagcaggtcggccgcatcgacgagatccacatcgagctggggcgggagatgaagaaccccgccgacaagcgcaagcggatgaccgcccagatcctcgagaacgagaacgccaacctgcgcatcaaggcgctgctcgccgagttcatgaacccggagtacgagatcgagaacgtgcggccctactcccccagccagcaggagatcctgcgcatctacgaggacaccgtgctgcacgccgaggaccagctccccgaggagatcgacgccatcctgaagaagttcaactccagcaaggtcccgaccaagagcgagttcctgcggtacaagctctggctggagcagaagtaccgctccccctacacgggcgagctgatccccctcgggaagctgttcaccgcggcctacgagatcgagcacgtgatcccgcagagccggtacttcgacgactccttcagcaacaaggtgatctgcgagtccgccgtcaacaagctgaaggacaaccagctcggctacgagttcatcaagaaccaccacggccagaaggtggaggtggggttcggcaagagcgtcgagatcttctccgtggacagctacgagcgcttcgtgaaggagcagtacgccaagtccgccgtcaagatgaagaagctgctgatggacgacatccccgagcagttcatcgagcggcagctcaacgacagccgctacatctccaaggtgatcaaggggctgctgagcaacatcgtgcgggagaagaacgactccggcgagtacgagcccgaggcggtcagcaagaacatcgtggtgtgcaccgggtccgtcaccgaccgcctcaagcgggactggggcatgaacgacgtgtggaacagcatcgtgtacccccgcttcgagcggctgaactccctgacggacacccagagcttcggccactgggagaacaagagcgggaagaaggtcttccagaccgagctcccgctggagtaccagaagggcttctccaagaagcgcatcgaccaccggcaccacgccatggacgccatcgtgatcgcctgcgccacccgcaaccacgtgaactacctgagcaacgagtccgcgagccgcaacgccaagatctcccggtacgacctccagcgcctgctgtgcgacaagaaccggaccgacgacaacgggaactacaagtgggtcatcaagaagccctgggacacgttcacccaggacgcccgcgaggtgctcagcaagatcgtggtctccctgaagcagaacctgcggatcatcaacaagaccaccaacgtgtaccgccacctcgacgccacgggcaaccgggtgtacgagaagcagaagaccggcgacagctgggccatccgcaagcccatgcacaaggacaccgtcttcggggcggtgaacctgcggaaggtgaaggtcgtgcgcctgtccgtggccctcgacacccccgccatgatcgtcgacaagcgggtgaagaacaaggtcttcgagctgctgagctacaagtacgacaagaagcgcatcgagaagtacttcaaggagaacgccttcctctggaaggagctggacctggcgaaggtggccgtgtactacttcacggaggccaccaccgagccgctcgtcgccgtgcggaagcccctggactccaccttcaacgagaagaagatcaaggagagcgtgacggacaccggcatccagaagatcctgctcaaccacctgtgcaccaaggaggggaagcccgacctggccttctccgcggagggcatcgaggagatgaaccgcaacctcctgcagctgaacaacggcaagagccaccagcccatctacaaggtccgggtgtacgagccgcgcgggaacaagttctccgtgggcgtcctcgggaacaagggcaccaagtgggtggaggccgccaaggggacgaacctgttcttcgccatctacatcaccgaggacggcaagcggacctacgagaccatccccctgaacgtggtcatcgagcgcgagaagcaggggctcgtgcccgtgcccgaccggaacaagaagggcgacaagctgctgttctggctcagcccgaacgacctggtctacctgcccacggaggaggagcgcgagttcggccgcatcaacgagcccatcgaccgggggcgcatctacaagatggtgtcctgcaccggcaacgaggggcacttcatccccgccaacgtggcgaacccgatcgtccccgtgatcgagctcggcagcaacaacaaggcccagcgggcctggaccaacgagatgatcaaggacatctgcatccccatcaaggtggaccgcctggggcacatcatcgaggtcaagtaccggatcgacgagtga

SEQ ID NO: 2266 - RNA, 4530 nt, synthetic construct
  misc_feature 1..4530: note = Cas9 variant
  source 1..4530: mol_type = other RNA
atgaagaagatcctgggcctcgacctggggaccaacagcgtgggctgggccgtcatcaactccgtggtgaacgacgaggggaaggagcagctggtcaacatcagctcctgcggcagccgcatcatccccatggacgccgcgaccctcggggacttcgacaagggcaactccaagagcccggtggccgagcggacgcgcctgcggggcgtgcgccggctgctcgagcgctccctgctgcggcgcgagcggctccaccgcgtcctgagcgtgatggggttcctgcccgagcactacgccgcccagctcgaccggtacggcaagttcctgcccgagaccgagcccaagctggcctggtacaaggacgagaccgggaagtaccgcttcctcttccaggactccttcaacgagatgctggaggacttccacgagcaccacccggagctggtggcggagggcaagaagatccactacgactggaccatctactacctccggaagaaggccctgagccagaagatcacgaaggaggagctggcctggatcctcctgaacttcaaccagaagcgcgggtactaccagctgcggggcgaggaggagcaggaggacaacaagaagtccgtcgagtactacgccctcaaggtggtggcggtcgaggacagcggcgaccgcaaggggaaggacatctggtacaacgtgaagctggagaacggctgggtgtaccggcgcgcctccggggtccccctggactgggtgggcaaggtgaaggagttcatcgtcaccaccgacctcgacgagaagggcaaccccaagaaggacaaggacgggaacgtgaagcggagcttccgcgcccccaaggaggacgactggggcctgctgaagacccggacgcaggcccagatcgacgagtccgggcagaccgtgggcacctacatctacgagagcctcctgcgcatgccggaccagaagatccgcgggaagctggtccggaccatcgagcgcaagtactacaaggacgagctccggaagatcctgatcaagcagtccgagttccacacggccctgcaggaccacaacctcctgctggcgtgcatcgaggagctctaccccaacaacgaggcccaccgccggctgctgagcacctccgacttcacctacttcctcgtggaggacatcctgttctaccagcgccccctcaagagccagaagggccagatcgacgactgcccctacgagagccacgtgtaccgggacaagaaggacggctccctccagcacgtcccgctgaagtgcgtgagcaagtcccaccccctgttccaggagttccgcctctggcacttcctgagcttcctgcggatctaccagcgcgagcggatgatcgacgggtccctgaagctcgacgtcgacgtgaccaacgagttcctgcagaacgaggacgactacgtgaagctgttcgactggctcaacgagcgcaaggagatcgaccagaagacgatcctggcctacaagcccttcggcctgaagaagaacgagcagagcaagtaccggtggaactacgtcgaggacaagtcctacccctgcaacagcacccgcgccgacatgatcttccggctctccaaggccggggtgccggaggagttcctgacccgcgagaaggaggaggcgctgtggcacatcctctacagcatctccgacaagaaggagctgaccaaggccctgggcacgttcgccgagaagaacgggctcaacgagaccttcgtggagatcttcagcaagatgccgcccttcgagtccgactacgccgcctacagcctgaaggcgatccggaagctgctcgccctgatgcgcatgggcaagtactgggacgagcaggccatcgacgagcacacccggtcccgcatcgagaagatcctgaccggcgagtacgacgagacgatccgcacccgggtccgcgagaaggccatgcacctcaccgacatcagctccttccgggggctgcccctgtggctcgcctgctacgtggtgtacgaccgccacagcgaggcgaaggagctggtcaagtgggagacccccgacgacatcgaccacttcctgcggaagttcaagcagcactccctccgcaaccccatcgtggagcagatcatcatggagacgctgcggaccgtgcgcgacatctggaagcaggagggcaagatcgacgagatccacgtcgagctggggcgggagatgaagaaccccgccaaggagcgcgcccggatcaccgcccaggtgctcgagaacgagaacaccaacctgcgcatcaaggcgctgctcgccgagttcatgaaccccgagttcgagatcgagaacgtgcggccgtacagccccgcccagcaggagatcctgcgcatctacgaggagggcgtcctgagcggggtggccgagaaggacctccccgacgacatcgcctccatcctgaagaagttccgggagaacgacgtgaagaagcgccccacgaccagcgaggtcctgcggtacaagctctggctggagcagcgctaccggtccccgtacaccggccgcatcatccccctgggcaagctgttcacccccgcgtacgagatcgagcacgtgatcccgcagagccggtacttcgacgactccttcacgaacaaggtgatctgcgagagcgccgtcaacaagctgaaggacaactgcctggggtacgagttcgtgaagaagcactccggcgagaaggtggagctcgggaacggcgagaccgccaccatcttcagcgtcgaggagtacgagcgcttcgtgaaggactcctacttcaacaacagcaagaagatcaagaagctgctgctcgaggacatccccgacaacttcatcgagcgccagctgaacgactcccggtacatcagcaaggtggtcaagtccctgctcagcaacatcgtgtgcgaggagggcgagcaggaggggatgtccaagaacgtgatcgtctgcaccggcggggtgaccgaccgcctgaagaaggactggggcgtgcaggacgtctggaaccggatcatcctgccccgcttcctccggctgaacaagatgacggaccgcaccgacttcaccgccgtgagcaccaacgggcacctcctgcccgccgtgccgctgcacctccagaagggcttcaacaagaagcggatcgaccaccgccaccacgcgatggacgccatcgtcatcgcctgcgccggccggaacatcgtgaactacctgaacaacgcctccgcgcgcaaggggagcgagatcagccggtacgacctgcagcacctcctgtgcgacaaggtgaagacggacgccaacggcaactacaagtggatcctgcgcaagccctgggagaccttcacccaggacctgtacgccgccctcaccaacatcgtcgtgtccttcaagcagaacctgcgggtgatcaaccgcacgaccaaccactaccagcactacaacgaggacggggagaagaagatgatcccccagaccaagggcgaccggctggcgatccgcaagcccatgcacaaggacaccgtctacggggaggtgaacctccggaaggagaagacgctgccgctgaaggacgtggtcaagaaccccagcgccgtggtggacaagtccctcaagaacaagctgtacgagctgctcaagagccagtacgacctgaaggccatcaccaagtacttcgagacccaccaggacgtctgggccgacgtgaacctgaagaagatcaaggtgtactacttcaccaaggagacgaacgagcgcttcttcgccacccggaagtccctcgacagctccttcagccagaagaagatcgaggaggaggtcaccgacaccggcatccagaagatcctgctgcgccacctccagcagaacggcaacaaccccgacatcgcgttctcccccgacggggtggagcgcatgaaccagaacatgacgatcctgaacgacggcaagtggcaccagccgatctacaaggtccggacctacgagaaggccgacaagttcgccgtgggggagaagggcaacaaggtgaagaagttcgtcgaggccgccaaggggaccaacctgttcttcgcggtgtacgagagcatccaggaggacgaggccaccggcaagcaggtccgcaagcggacgttcgccaccatccccctcaacgaggtgatcaagcgcaagaagcagggcctgcccgccgcccccgaggactccaaggggaacctgccgatcttcgtgctcagccccaacgacctggtgtacctgcccaccgaggaggagcggaactccggcaagatcatccagcccctcgaccgcgagcggatctacaagatggtcagctgcaccgagggggagtgccactgcatcccggagtacgtggcgaaccccatcctgcagacgatcgagctgggctccaacaacaaggcccagcgcgcctggagcggggagatgatcaaggagatctgcgtgcccgtcaaggtggaccggctcggcaacgtgtccctgatcaagatctga

SEQ ID NO: 2267 - RNA, 4530 nt, synthetic construct
  misc_feature 1..4530: note = Cas9 variant
  source 1..4530: mol_type = other RNA
atgaagaccatcctgggcctcgacctggggaccaacagcgtgggctgggccgtcatcaactccgtgatcaaggagcaggccgagcgcatctggatcgagacggcggggagccggatcatccccatggacgccgccgtgctgggcgacttcgacaaggggaactccatcagccagacctccgagcgcacccggctccgcggcgcccggcgcctgcgggagcgccagctgctccggcgcgagcggctgcacaaggtcctgaacatcctcggcttcctgccgaaccactacctggagtacatcgacttcgagaagcaccccgggaagttcctcgccgacgcggagcccaagctggcctgggtgaaggacgagcagggcaagtacaccttcctgttccaggccgccttcgacgagatgctcgcggacttcgccatccaccagcccagcctggtgtccggggacaagaagatcccgtacgactggacgatctactacctgcgcaagaaggccctcaccgagatgatcagcaaggaggagctggcctggatcctgctcaacttcaaccagaagcggggctactaccagctgcgcggggaggaggaggaggacaacgccggcaagtccgtcgagttctacgcgctgaaggtgctcaccgtggaggccaccgacgagaagaagggccgggacgtctggtacaacgtgcacctggagaacgggtggatctaccgccggagctccagcgtgcccctggactgggagggccaggtcaaggagttcatcgtgacgaccgacctcaaccccgacgggacccccaagctggacaagtacggcgaggtgaagcgctccttccgggccccgaaggaggacgactggatgctgatcaagaagcgcaccgaggccgacatcgccaacacgcacaagaccgtcggcgcgtacatctacgacaccctcctgcagaagccccagcagaagatcatcgggaagctggtgaagaccgtggagcggaagctctaccgcgacgagctgagcctgatcctccagaagcagtgcgccttccacgccgagctgcaggaccgcgccctgtacgcccggtgcgtcgaggcgctctacccctccaacgaggtgcgccggaagaacatcgccaaccgcgacttcgtgtacctgctgatggacgacatcctcttctaccagcggcccctgaagacgaagaagtccctgatcgccaactgcccgtacgaggagaacgagtacgtcgaccgcgagaccggcgagatcaagaaggcgcccctcaagtgcatcgccaagagccaccccctgttccaggagttccggctgtggaacttcctcagcaacatccgcatctaccagaaggagaaggagatcaacgggaccctgcacctggacgtggacgtgaccgcggagttcctgaagacggaggacgactacgtcgccctcttcgactggctgaactcccggaaggagatcgagcagaagaccttcctgaagtaccccaagttcggcctcaagaaggagatcagcaactaccgctggaactacgtggaggacaagcagtacccgtgcaacgagacccggcacgccatcctgagctccctggagaaggccaacgtctgcatcgacttcctcagcaacgagaaggaggtggcgctgtggcacatcctgtactccgtgagcgacaagcaggagatcgagaaggccctccgcaccttcgccgccaagaacgggctggacgagtccttcgtcgaggccttcaagaagttcccgcccttcaagagcgagtacggcgcgtactccgccaaggccatcaagaagatgctgcccctcatgcggtgcggcaagtactgggacgtgagctccatcgacgacacgaccaaggagcgcatcaagaagatcgtgaccggggagtacgacgagcggatcgccgtcaaggtgcgcgacaaggtgatgaacctgagcgacatctcctgcttccggcgcctgcccctctggctggcctgctacatcgtctacaaccggcacagcgaggacaaggaggcggtgaagtgggagtcccccgccgacatcgacgcctacctggccagcttcaagcagcactccctccgcaaccccatcgtggagcaggtcatcaccgagacgctgcgcgtggtgcgggacatctggaagcaggtcggccgcatcgacgagatccacatcgagctggggcgggagatgaagaaccccgccgacaagcgcaagcggatgaccgcgcagatcctcgagaacgagaacgccaacctgcgcatcaaggccctgctcgccgagttcatgaacccggagtacgagatcgagaacgtgcggccctacagcccctcccagcaggagatcctgcgcatctacgaggacaccgtgctgcacgcggaggaccagctccccgaggagatcgacgccatcctgaagaagttcaacagctccaaggtcccgaccaagagcgagttcctgcggtacaagctctggctggagcagaagtaccgcagcccctacacgggcgagctgatccccctcgggaagctgttcaccgccgcctacgagatcgagcacgtgatcccgcagtcccggtacttcgacgacagcttctccaacaaggtgatctgcgagagcgccgtcaacaagctgaaggacaaccagctcggctacgagttcatcaagaaccaccacggccagaaggtggaggtggggttcggcaagtccgtcgagatcttcagcgtggactcctacgagcgcttcgtgaaggagcagtacgccaagagcgccgtcaagatgaagaagctgctgatggacgacatccccgagcagttcatcgagcggcagctcaacgactcccgctacatcagcaaggtgatcaaggggctgctgtccaacatcgtgcgggagaagaacgacagcggcgagtacgagcccgaggccgtctccaagaacatcgtggtgtgcaccgggagcgtcaccgaccgcctcaagcgggactggggcatgaacgacgtgtggaactccatcgtgtacccccgcttcgagcggctgaacagcctgacggacacccagtccttcggccactgggagaacaagagcgggaagaaggtcttccagaccgagctcccgctggagtaccagaagggcttcagcaagaagcgcatcgaccaccggcaccacgccatggacgccatcgtgatcgcgtgcgccacccgcaaccacgtgaactacctgtccaacgagagcgcctcccgcaacgccaagatcagccggtacgacctccagcgcctgctgtgcgacaagaaccggaccgacgacaacgggaactacaagtgggtcatcaagaagccctgggacacgttcacccaggacgcccgcgaggtgctctccaagatcgtggtcagcctgaagcagaacctgcggatcatcaacaagaccaccaacgtgtaccgccacttcgacgcgacggtgaaccgggtctacgagaagcagaagaccggcgactcctgggccatccgcaagcccatgcacaaggacaccgtgttcggcgccgtgaacctccggaaggtcaaggtggtgcgcctgagcgtcgccctggacacccccgcgatgatcgtggacaagcgggtcaagaacaaggtgttcgagctcctgtcctacaagtacgacaagaagcgcatcgagaagtacttcaaggagaacgccttcctgtggaaggagctcgacctggccaaggtggccgtctactacttcacggaggccaccaccgagccgctggtggcggtgcggaagcccctcgacagcaccttcaacgagaagaagatcaaggagtccgtcacggacaccgggatccagaagatcctgctgaaccacctctgcaccaaggagggcaagcccgacctggccttcagcgccgaggggatcgaggagatgaaccgcaacctgctccagctgaacaacggcaagtcccaccagcccatctacaaggtgcgggtgtacgagccgcgcgggaacaagttcagcgtcggcgtgctgggcaacaaggggaccaagtgggtggaggccgccaagggcacgaacctcttcttcgcgatctacatcaccgaggacgggaagcggacctacgagaccatccccctgaacgtcgtgatcgagcgcgagaagcagggcctggtgcccgtccccgaccggaacgagaagggggacaagctcctgttctggctgtccccgaacgacctcgtgtacctgcccacggaggaggagcgcgagttcggccgcatcaacgagcccatcgaccggggccgcatctacaagatggtgagctgcaccgggaacgagggccacttcatccccgccaacgtcgccaacccgatcgtgcccgtgatcgagctggggtccaacaacaaggcccagcgggcctggaccaacgagatgatcaaggacatctgcatccccatcaaggtcgaccgcctcggccacatcatcgaggtgaagtaccggatcgacgagtga

SEQ ID NO: 2268 - RNA, 4530 nt, synthetic construct
  misc_feature 1..4530: note = Cas9 variant
  source 1..4530: mol_type = other RNA
atgaagaagaccctgggcctcgacctggggaccaacagcatcggctgggccgtgatcaactccaacatcgacagcgaggggaaggagaagctggtcggcatctccagctgcgggtcccgcatcatccccatggacgccacgaccctcggcgacttcggcaaggggaacaccaagagcccggtggcggagcggacccgcctgcggggcatccgccggctgctcgagcgctccctgctgcggcgcgagcggctccaccgcgtgctgagcgtcatggggttcctgcccgagcactacgcctcccagctcgaccggtacggcaagttcctgcccgagacggagcccaagctggcctggtacaaggacgacagcgggcgctaccagttcctcttccagaagtccttccacgagatgctggaggacttccggcagcaccagccggagctggtggccggcgagaagaagatcccctacgactggaccatctactacctccgcaagaaggccctgagccaggagatcaccaaggaggagctggcgtggatcctcctgaacttcaaccagaagcggggctactaccagctgcgcggggaggaggagcaggaggagaacaacaagtccgtggagtaccacgccctcaaggtcgtgagcgtggaggactccggcgagcggaaggggaaggacatctggtacaacgtcaccctggagaacggctgggtgtaccgccgggccagcaacatccccctggactggacgggcaaggtgaaggagttcgtcgtgaccaccgagctcgacgacgccgggaaccccaagaaggacaaggagggcaacgtgaagcgctccttccgggcgccgaaggaggacgactgggggctgctgaagacccgcacgcaggcccagatcgacgagagcggcaagaccgtcgggacctacatctacgagtccctcctgtgcatgcccaaccagaagatccgcggcaagctggtgcggaccatcgagcgcaagtactacaaggacgagctccggcagatcctggtgaagcagagcgagttccacgccgccctgcaggaccacaacctcctgctgagctgcatcgaggagctctaccccaacaacgaggcccaccgccggctgctgtccgcgagctccttcatctacttcctcatcgaggacatcctgttctaccagcgccccctcaagagccagaagggcctcatcgacaactgcccgtacgagtcccacatctacaaggacaagaaggacgggagcctgcaccacgtccccctgaagtgcgtgtccaagagccaccccctcttccaggagttccggctgtggcagttcctgtccaacctgcgcatctaccagcgggagcgcatgatggacggcagcctcaagctggacgtggacgtcacgcgggagttcctgccctccgaggaggactacgtgaagctgttcgactggctgaacgagcgcaaggagatcagccagaagttcctgctcgcctacaagccgttcgggctgaagaagaacgagcaggccaactaccggtggaactacgtggaggacaagtcctacccctgcaacgagacccgcgccgagatcaagagccggctgtccaaggccggcgtccccgaggagttcctcaccgaggagaaggaggaggcgctgtggcacatcctgtacagcatctccgacaagaaggagctcaccaaggccctggggacgttcgccgccaagaactgcctgaacgagagcttcgtggaggtcttcgccaagatcccgcccttcgagtccaactacgcggcctacagcctcaaggccatccgcaagctgctggccctcatgcggatgggcaagtactggaacgagcaggccatcgaccgccagacccgggaccgcatcgagaagatcctgaccggcgagtacgacgagaccatccgcagccgggtgcgcgagaaggcgatgctgctcacggacatctccagcttccgggggctgcccctgtggctcgcctgctacatcgtgtacgaccgccactccgagagcaaggagctggtcaagtgggagacccccgccgacatcgaccacttcctgtccaagttcaagcagaacagcctccggaaccccatcgtggagcaggtcatcaccgagtccctgcgcaccgtgcgggacatctggaagcaggagggcaagatcgacgagatccacgtggagctggggcgcgagatgaagaacccggccaaggagcgggcgcgcatcacggcccaggtgcaggagaacgagaacaccaacctccggatcaaggccctgctggccgagttcatgaaccccgagttcgagatcgagaacgtccacccctacagccccggccagcaggagatcctccgcatctacgaggacggggtgctgtccggcatcgccgagaaggacctgccggacgacatcaccgcgatcctcaagaagttccgggagaacgacgtgaagaagcgccccaccacgagcgaggtcctgcggtacaagctgtggctcgagcagcgctaccggtccccctacaccggccgcgtgatcccgctggggaagctgttcacccccgcctacgagatcgagcacgtgatcccccagagccggtacttcgacgactccatcagcaacaaggtcatctgcgagtccgccgtgaacaagctcaaggacaactgcctgggctacgagttcatcaagaagcacagcggggagatggtggagctgggcaacggcgagaccgtccccgtgttctccgtggaggagtacgagcgcttcgtcaaggagagctacttcgggaacagcaagaagatgaagaagctcctgctggaggacatcccggactccttcatcgagcggcagctcaacgacagccgctacatctcccgcgtggtgacgagcctgctgtccaacctcgtctgcgaggagggcgagcaggacgggctgagcaagaacgtgatcgtgtgcaccggcgggatcaccgaccggctgaagaaggactggggcgtccaggaggtgtggaaccgcatcatcctcccccggttcctgcgcctgaacgagatcaccggccggaccgacttcacgtccaccagcgtgaacgggcacctcctgcccgccctgcccctctacctgcagaagggcttcaacaagaagcgcatcgaccaccggcaccacgccatggacgcgatcgtcatcgcctgcgccaaccgcaacatcgtgaactacctgaacaactccagcgcccggaagaactccgagatcagccgctacgacctccagcggctgctgtgcgagaaggtgaagaccgacgccaacgggaactacaagtggatcctccgcaagccgtgggagaccttcacgcaggacgtctacgcggccctgaccaacatcgtggtgtccttcaagcagaacctgcgggtcatcaaccgcaccaccaactactaccagcactacaacgaggccggcgagaagcggatgatcccccagacgaagggggaccgctgggccatccggaagcccatgcacaaggacaccgtgtacggcgaggtgaacctccgcaaggagaagaccctgcccctgcgggacgtcgtgaagaacccgagcatcgtggtcgacaagtccctcaagaacaagctgtacgagctgctcaagagccagtacgacctgaaggcgatcgccaagtacttcgagacccaccaggacgtgtgggccgacgtgaacctgaagaagatcaaggtctactacttcacgaaggagaccaacgagcgcttcttcgccacccgcaagtccctcgaccccagcttcgaccagaagaagatcgaggaggaggtgaccgacacgggcgtgcagaagatcctgctgcaccacctccagcagaacaacaacgaccccgacatggccttctcccccgacgggatcgaccggatgaaccagaacatgaccatcctgaacgacggcaagtggcaccagccgatctacaaggtccgcacctacgagaaggcggacaagttcgccgtgggggagagcggcaacaaggccaagaagttcgtggaggccgccaaggggaccaacctgttcttcgcggtctacgagagcgtgcaggaggacgaggccatcggcaagcaggtctgcaagcggacgttcgccaccatccccctcaacgaggtgatcaagcgcaagaagcagggcctgcccgccgcccccgaggacctgaacgggaacctcccgaagttcgtgctgtcccccaacgacctggtctacctccccaccgaggaggagcggaacagctcccgcatcatccagcccctggaccgggagcgcatctacaagatggtgagctccagcggctcccagtgcttcttcatcaaggtgttcgtcgcgaacagcatctgggacaagaacgagtactccagcctgaacaagatggagcgggccatcaccaacgagatgatcaaggagatctgcgtgccgatcaagatcgaccgcctcgggaacgtgtccctgatccagatctga

SEQ ID NO: 2269 - RNA, 4533 nt, synthetic construct
  misc_feature 1..4533: note = Cas9 variant
  source 1..4533: mol_type = other RNA
atgaagcgcatcctgggcctcgacctggggaccaacagcatcggctgggccctggtggactccgaggagcagcggatcctcgggatgggcagccgcatcatccccatggaccagggggtcctggacaccttctccggcggcaacccggtggagacgcagaccgccgcgcggaccgtgtaccgcgggacccggcgcctgcgggagcgcgccctcctgcggcgcgagcggctgatccgcgtcctcaacatgatgaagttcctgcccgagcactacgccagccagatcgacttcgagaagcggctgggccagttcttcgacgagaaggagcccaagctcgcctggaagcagaacgacgaggggcgcttcgagttcatcttccagcagtccttcaacgagatgatcgaggagttcaagaacaagggcgtggtgcgggaggacaagaagatcccctacgactggacgatctactacctgcgcaagaaggccctgagccaggagatcgagaaggaggagctcgcgtggatcctgctgaacttcaaccagaagcgggggtactaccagctccgcggcgaggaggaggaggagaacccgaacaagctggtcgagtactactccctgaagatcgtggacgtgatcgccgacgagaagcccaacagcaagtccgacatctggtacagcctccacctggagaacggctggatctaccggcgctccagcaagatccccctgttcgggtggaaggacaagacccgggacttcatcgtcaccaccgacctcaacgacgacggcacggtgaagaaggacaaggaggggatcgagaagcgctccttccgcgcccccagcgagaacgactgggtgctgctgaagaagaagaccgagtccgacatcgagaagtcccacaagaccgtcggcgcctacgtgtacgagaccctcctgcagaacccgatgcagaaggtgcggggcaagctggtccgcacgatcgagcggaagttctacaaggacgagctcaagcagatcctggagaagcagcgcgagttccaccccgagctgcgggacgaggacctctacaacgactgcgtgcgcgagctgtaccggagcaacgagacctaccagttcatcctgagcaagcgcgacttcgtgcacctcttcctggacgacatcctgttctaccagcggcccctccgctcccagaagtccgcgatcggggactgcatcctggagttcaagacctacaaggacaaggacggcaacaacatcaaggagtacctgaaggtcatcagcaagagcaaccccctctaccaggagttccggatctggcagtggctgtacaacctgaagatctaccgcaaggaggacgacgaggacgtgaccctccagttcatcgccaacatcgaggacaaggagcagctgttcgacttcctgagcaaccggaagtccatcgagcagaagccgctcctggagtacctgatcaaggccaaggggctgaagaagcaggtcaagacggaggcctaccgctggaactacgtggaggacaagatctacccctgcagcgagaccaagaccatgatctccacccggctcgccaaggtggagaacatccccgacaacttcttcacgaaggagatcgagcagaagctgtggcacatcatctacagcgtgaccgacaagaacgagttcgagaaggcgctgcgcaccttcgccaagaagtacgacctcgacatcgcctccttcgtcgacaacttcaagaagatcccgccgttcaagaacgagtacggcagcttctccgagaaggccatcaagaagctgctgcccctcatgcggctggggaagtactggaagtggaacgacatcgacaacaacacccagaaccgcatcagcaagatcatcacgggcgagtacgacgaggagatcaaggacatcgtgcgggagaagtccatcgccctgaccaacgagaacgacttccagggcctccagctgtggctggcgcagtacctcgtctacgggcgccacagcgaggccgacatcgccggcaagtggcactccgtggccgacctggagaagtacctgaacgagttcaagcagcacagcctccgcaaccccatcgtggagcagatcatcaccgagaccctgcgggtcgtgcgcgacatctggcggaagtacgggcagggcgccgagaacttcttctccgagatccacgtggagctggggcgcgacatgaagaacacggcggacgagcggaagaagatcgtcaacgtggtgaccgagaacgagaacaccaacctccgcatcaaggccctgctgatggagctcaagaacaacagcgacggcaagctggaggtcgagaacgtgcggccctactccccgacccagcaggacatcctgaagatctacgaggagtacgccatcagcacgggcctcgacaacgagaaggacgagaaggtgaaggaggacatcaagaagatctcccgcgtcgcccagcccaccaccaccgagctgcagcggtacaagctgtggctcgagcagaagtactgcagcccctacacggggaaggtgatccccctgggcaagctgttcaccgaggagtaccagatcgagcacatcatccccaagagccgctactacgacgactccttcagcaacaaggtgatctgcgaggccgcggtcaacaagctcaaggacaagtgcctggggctggagttcatcaagaactaccacggccagatcgtggagaccgggttcggccagaaggtgaccatcttcgacgaggaggcctaccagaacttcgtcaagcagcactacgcctacaaccactccaagcggaccaagctcctgctggaggagatccccgagaagatgatcgagcgccagatgaacgacacgcggtacatcagcaagttcgtgctccccctgctgtccaacctcgtgcgcgccaaggagaacgacaacggcgtcaacagcaagaacgtgctgcccgtgaacgggaagatcaccaccatgctgaagcaggactggggcctcaacgacgtctggaacgacctgatcctgccgcggttcgtgcgcatgaacgagctcgcgaagaccatcgccttcacgtcctggaacgagcagcaccagaagtacctgcccaccgtgcccctggagctcagcaaggggttccagaagaagcggatcgaccaccgccaccacgccatggacgccctggtcatcgcctgcgcgacccgggaccacgtgaacctgctcaacaacaagcacgccaacaccgacacgatccgctacgacctgcagcggaagctgcgcctcttcgagcgcgtgacctacatcgacccgcagaccaagaacaacgtcaccaaggacatccccaaggagttcaagaagccctgggacaacttcacggtggacgcccggaacgagctggagaagatcatcgtgtccttcaagcagaacctgcgcatcatcaacaaggccaccaacatctacaccaagtacgagaacggcaagaagatcaaggtcggccagaaggggctcaactgggccatccggaagcccctgcacaaggagaccgtgttcgcgaaggtgagcctgcgcaagcggaagacggtccgcctctccgaggccctgaaggactggaagaagatcgtggacaagaagctgaagcaggagatcaagcggctgacctgccagtacggcaagttcgacgtggacaccatcctgcgctacttcaaggaccggaagtaccagttcggggaggtcgacgtgagcaaggtgaagatgtactacttcgacgaggagaacgccgccgtccgcaagaacgtggacacctccttcacggagaagttcatccagggcagcgtgaccgacaccgggatccagaagatcctgctcaaccacctggaggccaagggcaacaaggtcgagatcgcgttctccccggagggcatcgaggagatgaacaagaacatcatccagctgaacgaggggaagctccacctccccatcttcaaggtgcgggtgtacgagaccatcggcaacaagttcagcgtcggggtgaagggcaacaagaaggacaagtacgtggaggccgccaaggggacgaacctgttcttcgccatctacgtcgacgagaacggcatccgctcctacgagaccatccccctcaacatcgtgatcgagcggctgaagcagggcctgagcgtcgtgcccgagaagaaccgcaaggagcacagcctcctgttctacctgtccccgaacgacctcgtgtacgtccccatcgaggacgagcgggagaacatccacgcggtgaacctggaccagctgaacaacgagcagcgcaagcggatctacaagatggtgagctgcaccgggtccgagtgccacttcgtcccctactacgtggccagccccatcgtgaacaaggtcgagtactccagcctcaacaagatcggccgctccctgaccggggagatgatcaaggacgtgtgcatcaagctgaaggtggaccggctcggcaacatcaaggggatcagcggcctgtga

SEQ ID NO: 2270 - RNA, 4533 nt, synthetic construct
  misc_feature 1..4533: note = Cas9 variant
  source 1..4533: mol_type = other RNA
atgaagcgcatcctgggcctcgacctggggaccaacagcatcggctgggccctggtggactccgaggagcagcggatcctcgggatgggcagccgcatcatccccatggaccagggggtcctggacaccttctccggcggcaacccggtggagacgcagaccgccgcgcggaccgcctaccgcgggacccggcgcctgcgggagcgcgccctcctgcggcgcgagcggctgatccgcgtgctcaacatgatgaagttcctgcccgagcactacgccagccagatcgacttcgagaagcggctgggccagttcttcgacgagaaggagcccaagctcgcctggaagcagaacgacgaggggcgcttcgagttcatcttccagcagtccttcaacgagatgatcgaggagttcaagaacaagggcgtcgtgcgggaggacaagaagatcccctacgactggacgatctactacctgcgcaagaaggcgctgagccaggagatcgagaaggaggagctcgcctggatcctgctgaacttcaaccagaagcgggggtactaccagctccgcggcgaggaggaggaggagaacccgaacaagctggtggagtactactccctgaagatcgtcgacgtgatcgccgacgagaagcccaacagcaagggcgacatctggtactccctccacctggagaacgggtggatctaccggcgcagctccaagatccccctgttcggctggaaggacaagacccgggacttcatcgtgaccaccgacctcaacgacgacgggacggtcaagaaggacaaggagggcatcgagaagcgcagcttccgcgccccctccgagaacgactgggtgctgctgaagaagaagaccgagagcgacatcgagaagtcccacaagaccgtgggcgcgtacgtctacgagaccctcctgcagaacccgatgcagaaggtgcgggggaagctggtgcgcacgatcgagcggaagttctacaaggacgagctcaagcagatcctggagaagcagcgcgagttccaccccgagctgcgggacgaggacctctacaacgactgcgtccgcgagctgtaccggagcaacgagacctaccagttcatcctgtccaagcgcgacttcgtgcacctcttcctggacgacatcctgttctaccagcggcccctccgcagccagaagtccgccatcggcgactgcatcctggagttcaagacctacaaggacaaggacgggaacaacatcaaggagtacctgaaggtgatcagcaagagcaaccccctctaccaggagttccggatctggcagtggctgtacaacctgaagatctaccgcaaggaggacgacgaggacgtcaccctccagttcatcgccaacatcgaggacaaggagcagctgttcgacttcctgtccaaccgcaagagcatcgagcagaagccgctcctggagtacctgatcaaggccaagggcctgaagaagcaggtcaagacggaggcctaccggtggaactacgtggaggacaagatctacccctgctccgagaccaagaccatgatcagcacccggctcgcgaaggtggagaacatccccgacaacttcttcacgaaggagatcgagcagaagctgtggcacatcatctactccgtgaccgacaagaacgagttcgagaaggccctgcgcaccttcgccaagaagtacgacctcgacatcgccagcttcgtggacaacttcaagaagatcccgccgttcaagaacgagtacgggtccttcagcgagaaggccatcaagaagctgctgcccctcatgcggctgggcaagtactggaagtggaacgacatcgacaacaacacccagaaccgcatctccaagatcatcacgggcgagtacgacgaggagatcaaggacatcgtccgggagaagtccatcgcgctgaccaacgagaacgacttccaggggctccagctgtggctggcccagtacctcgtgtacggccgccacagcgaggccgacatcgccgggaagtggcacagcgtcgccgacctggagaagtacctgaacgagttcaagcagcactccctccgcaaccccatcgtggagcagatcatcaccgagaccctgcgggtggtccgcgacatctggcggaagtacggccagggggcggagaacttcttcagcgagatccacgtggagctgggccgcgacatgaagaacacggccgacgagcggaagaagatcgtgaacgtcgtgaccgagaacgagaacaccaacctccgcatcaaggccctgctgatggagctcaagaacaactccgacggcaagctggaggtggagaacgtccggccctacagcccgacccagcaggacatcctgaagatctacgaggagtacgccatctccacggggctcgacaacgagaaggacgagaaggtgaaggaggacatcaagaagatcagccgcgtggcccagcccaccaccaccgagctgcagcggtacaagctgtggctcgagcagaagtactgctccccctacacgggcaaggtcatccccctggggaagctgttcaccgaggagtaccagatcgagcacatcatccccaagagccgctactacgacgacagcttctccaacaaggtgatctgcgaggcggccgtgaacaagctcaaggacaagtgcctgggcctggagttcatcaagaactaccacgggcagatcgtcgagaccggcttcggccagaaggtgaccatcttcgacgaggaggcctaccagaacttcgtgaagcagcactacgcctacaaccggagcaagcgcaccaagctcctgctggaggagatccccgagaagatgatcgagcggcagatgaacgacacgcgctacatctccaagttcgtcctccccctgctgagcaacctcgtgcgggcggaggagaacgacaacggggtgaactccaagaacgtcctgcccgtgaacggcaagatcaccaccatgctgaagcaggactgggggctcaacgacgtgtggaacgacctgatcctgccgcgcttcgtccggatgaacgagctcgccaagaccatcgccttcacgagctggaacgagcagcaccagaagtacctgcccaccgtgcccctggagctctccaagggcttccagaagaagcgcatcgaccaccggcaccacgccatggacgccctggtgatcgcgtgcgccacccgcgaccacgtcaacctgctcaacaacaagcacgccaacaccgacacgatccggtacgacctgcagcgcaagctgcgcctcttcgagcgggtgacctacatcgacccgcagaccaagaacaacgtgaccaaggacatccccaaggagttcaagaagccctgggacaacttcacggtcgacgcccgcaacgagctggagaagatcatcgtgagcttcaagcagaacctgcggatcatcaacaaggccaccaacatctacaccaagtacgagaacggcaagaagatcaaggtggggcagaagggcctcaactgggcgatccgcaagcccctgcacaaggagaccgtcttcgccaaggtgtccctgcggaagcgcaagacggtgcggctcagcgaggccctgaaggactggaagaagatcgtcgacaagaagctgaagcaggagatcaagcgcctgacctgccagtacgggaagttcgacgtggacaccatcctgcggtacttcaaggaccgcaagtaccagttcggcgaggtggacgtctccaaggtgaagatgtactacttcgacgaggagaacgccgccgtgcggaagaacgtcgacaccagcttcacggagaagttcatccaggggtccgtgaccgacaccggcatccagaagatcctgctcaaccacctggaggcgaagggcaacaaggtggagatcgccttcagcccggaggggatcgaggagatgaacaagaacatcatccagctgaacgagggcaagctccacctccccatcttcaaggtccgcgtgtacgagaccatcgggaacaagttctccgtgggcgtcaaggggaacaagaaggacaagtacgtggaggccgccaagggcacgaacctgttcttcgcgatctacgtggacgagaacggcatccggagctacgagaccatccccctcaacatcgtcatcgagcgcctgaagcaggggctgtccgtggtccccgagaagaaccggaaggagcacagcctcctgttctacctgagcccgaacgacctcgtgtacgtgcccatcgaggacgagcgcgagaacatccacgccgtcaacctggaccagctgaacaacgagcagcggaagcgcatctacaagatggtgtcctgcaccggcagcgagtgccacttcgtgccctactacgtcgcctcccccatcgtgaacaaggtggagtacagctccctcaacaagatcgggcggagcctgaccggcgagatgatcaaggacgtctgcatcaagctgaaggtggaccgcctcgggaacgtgaagggcatctccggcctgtga

SEQ ID NO: 2271 - RNA, 4536 nt, synthetic construct
  misc_feature 1..4536: note = Cas9 variant
  source 1..4536: mol_type = other RNA
atgaagaagatcctgggcctcgacctggggaccaacagcatcggctgggccgtgatcaacagcgtcgccgacgagagcgtggagaagcgcaacatcgagctggcggggtcccggatcatccccatggacgccgccgtgctcggcaacttcgacaacggggtcaccaagagccagacggccgagcgcacctcctaccggagcatccgccggctgcgcgagcggcagctgctccgccgggagcgcctgcacaaggtgctgcagatcctcggcttcctgccggagcactacgtgaacgacatcgacttcgagaaccaccccggcaagatcaagaagaacaccgagcccaagctgccctggcggaagaactccatggggcagttcgagttcatcttccaggccagcttcgaggcgatgctcaccgacttcgccacgcaccagccggtcttcgtgtccgagggcaagaaggtgcactacgactggaccctgtactacctgcgcaagaaggccctcaccgaggagatcagcaaggaggagctggcctggatcatcctgaacttcaaccagaagcgggggtactaccagctccgcggcgaggaggaggaggagcagtccaacaagctggtcgagttctacgcgctgcgggtggtgaaggtcgaggccaccgacgacaagaaggggaaggacacgtggtacaacgtgcacctcgagaacggctggatctaccgccggaccagcaacatccccctggactgggagggcaaggtgaaggagttcatcgtcaccaccgacctgaacgaggacgggacgcccaagctcgacaagtacggcgaggtgaagcgctccttccgggcccccaaggaggacgactggaccctgatcaagaagaagaccgagagcgacatcgccaactcccacaagaccctggggtgctacatctacgacgccctcctgcagaacccgaaccagaagatcaagggccgcctggtgcggacggtcgagcgcaagttctacaaggaggagctccgcctgatcctggagaagcagctcagcttccaccccgagctgcaggaccgggacctgtaccgcgcgtgcatcgacgccctctacgtgtccaacgaggcccacaagaacaacatcagcggccgggacttcgtgtacctgttcatcgacgacatcatcttctaccagcgccccctgaagaccaagaagtccctcatcgacaactgcccctacgagaagaaccagtacatggaccgggagaccggggaggtcaagcaggccccgatcaagtgcatcgccaagagccaccccctgttccaggagttccgcctgtggcagttcatcagcaacatccggatctaccagcgcgagcgggtgatggacgacggcaagctcgagaccgacgtggacgtcacgcccgacttcctgaagaccgaggacgactacaccaccctgttcgagtggctcaacgaccgcaaggaggtggaccagaaggcgttcctgaagaacccccagttcgggctgaagaagacgttcaccgagtaccggtggaactacgtcgaggacaagtcctacccgtgcaacgagacccgcaacgccatcctcaacggcctgcagaaggccggggtgagcgccgacttcctgtcccgggaggtggaggaggccctgtggcacatcctctacagcgtcgaggacaagatcgagatcgagtccgcgctgcgcaagttcgccagcaagcacgacctggacgaccggttcgccgacgtgttcaagaagctcccgcccttccgcaaggagtacggcgcctactccgccaaggcgatcaagaagctgctgcccctcatgcggatgggcaagtactgggagctgagcaacatcgacgacaagaccaaggagcgcatcgacaagatcatcacgggggagtgggacgagaacatccacaaccgggtgcgcgagaaggccatcaagctgtccgacatcaccgacttcaagggcctccccctgtggctgagctgctacgtcgtgtacaaccgccactccgaggcccgggccatcgcgaagtgggagagccccgaggacatcgactcctacctccgcctgttccggcagcacagcctgcgcaaccccgtggtcgagcaggtcatcaccgagaccctccggacggtgcgcgacatctggaagcggatcgggcagatcgacgagatccacgtggagctgggccgcgagatcaagaaccccgccgacaagcgggccaagatgaccgcccagatcgtggagaacgagaacaccaacctgcgcatcaaggccctcctggcggagttcatcaactccgagtacgagatcgagaacgtgcggccgtacagccccgggcagcaggagatcctgcgcatctacgaggacaccgtcctcaactccgtggaggagatccccgaggacatcagcgccgtgctgaagaagttccgggagtccgacctgaagaagcgccccaccaagagcgagttcctccggtacaagctgtggctggagcagaagtaccgcagcccgtacacgggcgacatcatccccctcggcaagctgttcacctccgcctacgagatcgagcacatcatcccccagagccggtacttcgacgactccttcagcaacaaggtcatctgcgaggccgaggtgaacaagctgaagtccaacgagctcgggtacgagttcatcaagaaccaccacggccagtacgtggagatcgggttcggcaaggtcgtgcagatcttcagcatcgaggcctacgagaagttcgtgaaggcgaactactccgggatcggcagcaagatgaagcgcctgctgatggacgacatcccggagaccttcatcgagcggcagctcaacgactcccgctacatcagcaaggtcgtgaagtccctgctgagcaacatcgtgcgggagaaggactccaacggcgagtacgagcccgaggccatcagcaagaacgtcatcgtgtgcaccgggtccgtgacggaccgcctcaagcgcgactggggcgtcaacgacgtgtggaacagcatcatctacccccggttcgagcgcctgaacgagctgaccgggtcccagcagttcggctgctgggagaacaaggagggcaagcgggtgttccagaccgccgtccccctcgagatgcagaaggggttcagcaagaagcgcatcgaccaccggcaccacgccatggacgccatcgtgatcgcgtgcgccatccgcaaccacatcaactacctgagcaacgagtccgccagcaagaaggccaagatctcccggatcgacctgcagcgcctcctgtgcaccaagtgccggacggacgacaacggcaactacaagtggatcgtgaagaagccgtggcccgcgttcacccaggacatccgcaaggccctggagaacatcaccgtcagcttcaagcagaacctccgggtgatcaacaagaccacgaactactacgtgcacttcgacgagtccgggaagaaggtcctggagaagcagatcaacggcgacagctgggccatccgcaagcccatgcacaaggacaccgtgttcgggaaggtgaacctgcagaaggtcaaggaggtgcggctctccctggccctggacacccccaagatgatcgtggacaagaagctcaaggagaaggtcctgcagctgtacagctacaagtacgacaagaagcgcatcgacaagtacttcaaggagaacgcctccctctggaaggacctgaacctgagcaaggtggcggtgtactacttcaccaacgactccacggagccgctcgtcgccgtgcggaagcccctggacaccagcttcaacgccaagaagatcaaggagtccgtgaccgacaccggcatccagaagatcctgctcaaccacctgagcaacaaccaggacaaccccaacctggccttctcccccgacggcatcgacgagatgaaccgcaacctcacgaccctgaacgacgggaagtaccaccagccgatctacaaggtccgggtgtgcgagccccagggcaacaagttcagcgtcgggacctccggcaacaagaccagcaagtacgtggaggccgcgaaggggacgaacctgttcttcgccgtgtaccagaccgaggacggcaagcgcaactacgagaccatccccctcaacgtcgtgatcgagcgggagaagctggagtgggcccccgtgccggagaacaacaacaacggcgacaagctcctgttctggctgtcccccaacgacctggtctacgtgcccaccgccgacgagctcaacaacgggatgcgcctggacaacatggacaagggccgcatctacaagatgatcagctgcagcgggccccagtgcttcttcatcccgcagaacgtgtccaaccccatcatccccgtcatcgagctgggcgtgaacaacaaggccgagaagtcctggaacaacgagatgatcaaggtggtctgcgtgcccatccgggtggaccgcctcgggtgcatcacgcagatcaacaaccagaagtga

SEQ ID NO: 2272 - RNA, 4539 nt, synthetic construct
  misc_feature 1..4539: note = Cas9 variant
  source 1..4539: mol_type = other RNA
atgaagaagatcctgggcctcgacctggggaccaacagcatcggctgggccctgatcgagaactccttcaccgagaaggaggggaagatcaacgacatgggcgtgcgcatcatccccatgagcgccgacatcctcgggaagttcgacgcgggccagtcccacagccagacggccgagcggaccggctaccgcgggacccggcgcctgtaccagcgggacaacctgcgccgggagcgcctccaccgggtcctgcacatcctgggcttcctcccgaagcactacgacgagcacatcgacttcgagaagcgcctggggcagttcaaggagggcaaggagatcaagctgaactaccggtgcaacgtggagaacaagcacgagttcatcttcatctccagcttcaacgagatgctcaccgagttcaagaaggcccagcccgagctgttctacctgaagtccaacggggaggagacgaagatcccctacgactggaccctctactacctgcgcaagaaggccctgagccagcccctcaccaagcaggagctggcctggatcatcctgaacttcaaccagaagcggggctactaccagctccgcggcgaggagatcgacgacgacaagaacaagcagttcgtgaagctgaaggtcaaggaggtgatcaactccggggaggcggtgaagggcaagccgctgttcgacgtcatcttcgagaacgggtggaagtacgacaagcaggtcgtgaagaccgaggactggatcgaccggacgaaggagttcatcgtgaccaccaaggtgctcaagaacggcgacctgaagcgcagctacaagaccgtggactccgagaaggactgggccgccatcaaggccaagacggagcaggacatcgagcggagcaacaagaccgtcggcgagttcatctacgagaccctgctcgagaaccccacccagaagatccgcgggaagctggtgaagacgatcgagcggaagttctacaaggaggagctgaagaacatcctcatcaagcagatcgagctgcagcccaccctgttctccgaggagctctacaaggcgtgcatcgaggagctgtacccccgcaacgaggcccaccagaacgccatcaagaaccgggacttcatctacctgctcatggacgacatcatcttctaccagcgcccgctcaagagccagaagtccaacatcagcggctgccagctggagcagcgcgtgtactacaaggccaacaaggactccggggagaacgaggaggtcaagcaggccgtgaaggcgatccccaagagccaccccctgttccaggagttccggaactggcagtggctgcagaacctgaagatctacaacaaggtggacaccgagaagggcgagctcaccgacgtcacgaagcagctgctgccctccgaggacagctgggtgaacctcttcaacttcctgcagtgcaagaaggagctggagcagaagcagttcatcaagtacttcatcgacaagaagctcatcaacaagaccgagaaggaccactaccgctggaactacgtggaggacaagaagtacccgttcaccgagacccgggcccagttcatcagccgcctgacgaaggtcgaggggatcgaggagatcaacaccttcctggacaagaagacccagatcggcaccaaggacaactcccccttcgtgagccggatcgagcagctgtggcacatcatctactccgtgagcgacatcaaggagtacgagtccgccctcgagaagttcgccatcaagcaccacctgaacgaggagagcttcgtcgccaacttcatcaagttcccgcccttcaagtccgactacggcagctactccaagaaggcgctgaacaagctcctgcccctgatgcgccgggggaactactggacggagaacgacatcagcgagaaggtgaagctccgcgtctccgagatcatggagcgggtgaacgccctgaacctgaaggaggactacagctccaaggagctcgccgagaccctggtgaacgtcagcgacgacgacgtgaagaagcagctgatcaagtccttcgtgagcttcaaggaccgcaaccccctcatgggcctgaacaccttccaggccacctacctggtctacgggcggcactccgaggtgggcgacatccagaactggaagacgcccgacgacatcgacacctacctcaagaacttcaagcagcacagcctgcgcaaccccatcgtggagcaggtcgtgaccgagaccctgcgggtggtccgcgacatctggaagcaccacgggaagtcccagacgaacttcttcaacgagatccacgtggagctcggccgggagatgaagaacccggccgacaagcgcaagcggatcagcgagcgcaacaccgagaacgagaacaccaacaaccggatccgcgagatcctgaaggacctgatgaacgacgcgagcatccagggcgacgtgcgcgactactcccccagccagcaggggatcctcaagatctacgaggagggcgtctaccagaaccccaaggtggactactccaaggtgagcgaggacgagatcaccaagatccggcgctccaacaaccccacccagaaggagatccagcggtaccgcctgtggctggagcaggggtacatcagcccgtacacgtgcaagcccatccccctctccaagctgttcacccaccactaccagatcgagcacatcatcccccagagccggtacttcgacaactccagctccaacaagatcatctgcgagagcgaggtcaacgaggacaaggacaacaagaccgccttcgagtacctgaaggacaagggcgagaacgtgatcaacgggcacaagctcctgtccctggccgcctacgaggcccacgtgaacaagtacttcaagaacaaccgccagaagctcaagaacctgctgagcgaggacatcccggagggcttcatcaaccggcagatgaacgactcccgctacatcagcaagctcgtcaagggcctgctgtccaacatcgtgcgggaggagggggagcaggaggtgaccagcaagaacctcatccccgtcacgggcagcgtgacctccaagctgaagaacgactgggggctgaacgacaagtggaacgagctcatcctgccccgcttcaagcggctgaaccagctcacccagaccaacgacttcacgaccgcgaacaccaacggcaacaccatcccgacggtgcccgacgagctgctgaagggcttcagcaagaagcgcatcgaccaccggcaccacgccctcgacgccctggtcgtggcctgctgcacccgcaaccactccaactacctgagcgcgctcaacaccgagaacaagaactacgggctgcgggacaagctgctcatcaagaacgacaacgaccactacaccaagtccttccagatgccctggcacggcttcacgaccgaggccaagaaccagctggaggagaccgtgatcagcttcaagcagaacctgcgcgtcatcaacaaggccaacaacaagttctggtcctacaaggacgagaacgggaagctcaacctggacaagaacggcaagcccatcaagaagctgcggaagcagaccaagggggacaactgggccgtgcgccagccgctccacgaggagacgatcagcggcatcgtgaacctgccctgggtcaaggccgagaaggagaagttcacctacgcgacccggaagtccctggacaagagcttcgacctcaagaagatcgagaagatcaccgacacgggcatccagaagatcctgcgcaactacctgatgcaggagaagttcaaggagctcgacaagaaggacaaggaggtgtacaactccgagctggccttcagccaggaggggctggaggacctcaactccaacatcgagcagttcaacgaccagaagccccacaagcccatctacaaggtgcggctgttcgagaagggcagcgggcgcttcgccctgggcttcaaggggatcaacgccaagaagtacgcccagggctccccgaacctctacttcaacatctaccgcaacgaggacggccagtactacgagaccgtccccctgaacaaggtgatcatccaccagaagaacgcggccaacatgcccaagaagaaccggacccccgtgccgatcagcaacaccgccatcaaccgctccaaggaggtcctggtggactacaagatgacgctcagccccctggacctggtgtacatccccaccgaggaggagctcaacaacatcaactccctggacttcaacaacctgagcaagagccagcggaagcgcctctacaacgtcaacgacttctccgggtacaccatctacttcagccccaacaccctggccaagtccatctgcccgaaggaggtggacatgaagttcgacgagaagaagcagaagcccacgggcagcttcgactccaagaccgccagcctggacgggatgtccatcaaggagcggtgcatcaagctcatcatcgaccgcctgggcaacatcagcaaggcgtga

SEQ ID NO: 2273 - RNA, 4539 nt, synthetic construct
  misc_feature 1..4539: note = Cas9 variant
  source 1..4539: mol_type = other RNA
atgaagaagatcctgggcctcgacctggggaccaacagcatcggctgggccgtggtcaacgccgacgagatcacccgcgacgacgggtcccggtacctgaagcccaacggcatcagcgcggccgggtcccgcatcatcccgatgagcgccgacatcctcggcgacttcgagaagggcaactccatcagccagacggccgagcggacccgcatgcggatggcccgccggctgcacgagcgcgcgctgctccggcgcgagcggctgctgcgcgtgctcaacctgctggacttcctccccaagcacttcgccgacaagatcgaccggtacgggaagttcaccgacgactccgagcccaagctggcctggcgcaagaacaccgagggcaagtacgagttcatcttccaggacgccttcaacgagatgctggcggagttcaaggacaagcagcccgagatcgtggaggaggggaagaagatcccgtacgactggacgatctactacctccggaagaaggccctggagaaggccctgagcaaggaggagctctcctggatcctgctgcagttcaaccagaagcgcggctactaccagctccgcggggaggaggaggagatcccccaggacaagaagatcgagtacctggcccagaaggtcgtgaaggtggaggccaccgaccagaagaagggcgacgacgtctggtacaacgtgtacctggagaacggcatgatctaccggcggaccagcaaggcgcccctcgactgggaggggaaggtgaaggagttcatcgtcaccacggaggtggagaacgacggcgagacccccaagaaggacaaggaggggaacatcaagcgctccttccgggccccgaaggaggacgactggaccctgctgaagaagaagaccgaggccgacatcgagaacagccacaagacggtgggctgctacatctacgactccctcctgaacaaccccaagcagaagatcatcggcaagctggtccgcaccgtggagcgcaagttctacaaggaggagctcacccagatcctgaagaagcaggtcgagctgatccccgagctccgggacgacaacctgtacaagcagtgcatcgaggagctgtaccccatcaacgaggcccaccgcaacaccatcgccaagacggacttcgcgaacctcttcatcaacgacatcctgttctaccagcggccgctcaagagcaagaagtcccagatcgacaactgcccctacgaggagcgcatcttcatcgacagcaagaccggggagaagaagaaggtgcccgtgaagtgcatcgccaagtccaaccccctgttccaggagttccggctgtggcagttcatccagaacctgcgcatctaccagcgggagaaggagatcgacggcaagctcctgaccgacatcgacatcaccagcgagtgcctgaagtccgaggaggactacgtgcgcctcttcgactggctgaacgaccgggagacgatcgagcaggaggacctgctcaagcacctgttcaacaccaagaagtccaagaacaaggagaacccgtaccgctggaactacgtcgaggacaaggtgtacccctgcaacgagacccgggccaccatcctgaaggggttcagcaagtgcggcatcaacgccagcgtgctgagccccgagctcgagatggccctgtggcacatcctgtactccgtcgaggacaagaaggagatcgagacggcgctcacccacttcgcccagaagcaggggtggaacgacgacttcgccaaggtgttcagcaaggccaagcccttcaagaaggactacggctcctacagcgagaaggccatcaagaagctgctgtccctcatgcgcatgggcaagtactggaaccaggacaacatcgacaagaacaccctggaccggatcgacaagatcatcaacggggagtacgacgagaagatcagcaaccgcgtgcgggacaacgcgatcaacctgaaggacatctccgacttccgcggcctcccggtctggctggcctgctacatcgtgtacgaccggcacagcgaggccaaggactgcaccaagtggaactcccccgaggagatcgacagctacctgaagaagttcaagcagcactccctccgcaaccccatcgtcgagcaggtcgtgacggagaccctgcggaccgtgcgcgacatctggatccaggaggagcagatcgacgagatccacctggagctcgggcgcgacctgaagaaccccgccgacaagcggaagaagatgagcgagaacatcctgaagaacgagaacaccaacctccgcatcaaggcgatgctgatggagttcatgaacccgtccatgggcatcgagaacgtgcggccctacagcccctcccagcaggacatcctgcgcatctacgaggagaacgccctcgacaacctgacgaaggacgacaaggacttcgacttcatcagcaagatctccaagcaggcccagcccagcaagaccgacatcatccggtacaagtgctggctggagcagaagtaccgcagcccgtacaccgggaagaccatctccctcagcaagctgttcacgcccgcctacgagatcgagcacgtgatcccccagtccctgtacttcgacgacagcttctccaacaaggtcatctgcgaggccgaggtgaacaagctcaaggaccggcagctgggctacaagttcatcgcggagcaccacggcgagaaggtgcagctgagccagggggaggtcgtggagatcctctccgtggacgcctacgagaagttcgtcaaggagaactacgccaacaaccgcatcaagatgaagaagctgctgatggagagcatcccggacgagttcatcgagcggcagctcaacgactcccgctacatcagcaaggtggtgaagggcctgctgtccaacatcgtccgggagaagatcgacgacgagaactacgagcccgaggccgtgagcaagaacctcatctcctgcaacggggccatcaccgaccgcctgaagaaggactggggcatgaacgacgtgtggaacagcatcatcctgccccggttcatccgcatgaaccagatcaccgggaaggactgcttcaccaccacgaacgcggagggccacctcatcccccagatgccgctggagctgcagaagggcttcaacaagaagcggatcgaccaccgccaccacgccatggacgccatcgtcatcgcctgcaccacccgggaccacgtgaacctcctgaacaacgaggccgcgcactccaagttcaacgccacccgctaccagctgcagcggaagctccgccggttcgagaaggccgtgatcgacgggaaggagcgcgaggtcgccaaggagttcctgaagccctgggacagcttctccagcgacagcaagaacatcctggagaacatcatcgtgtccttcaagcagaaccagcgcgtgatcaacaagacgaccaacgcgttcctccacttcgacgagaacggcaagaagaccttcatcaagcaggggaagggcgacagctgggccatccggaagtccatgcacaaggacaccgtcttcggcgagatcaacctgcgcaaggtgcggagcgtgtccctgaacgaggccatcaaggtccccgagcgcgtgctcaacaagaagatcaaggagaagatcctggagctgaagaacaacaagatcgacgccaagaacatcaagaagtacatcgaggagaaccacaccgggggctacgggatcgacagctccaagatcgacgtgttctacttcacgaaggagaccaaggagcggttcttcgccacccgcaagacgctcgacaccagcttcaaccaggcgaagatcaaggactccatcgccgacagcggcatccagaagatcctgctggcccacctcaagtccaagaacggggacgccgagcaggccttcagccccgacggcatcgacgagatgaacaagaacatcgtcgagctgaacaacggcaagttccaccagccgatcctgaaggtgcgggtgtacgagaaggcggacaagttcgccgtcgggcagaagggcaacaagaaggtgaagttcgtggaggccgccaaggggaccaacctcttcttcgccatcttcgagaaggacggcaagcgctcctacctgaccatccccctgaacgtcatgatcgactgccagaagcagtacgggaaccagtggaagaacaacatcgaggcgtacctcaaggagaaggagctggtggagaaggacgtgaagctgcagttcatcctcagccccaacgacctggtctacctgcccacggagggctccatcgacaagaagcggatctacaaggtggtgagcttcaccaacaaccgcctctacgccatcccgtacgccatcgccaagtccatcgtcgacaagaacgagttcacccagctgaacaagatcgagttcaccgacaacaaggagagcatcaaggacgcgtgcgtgcccgtgatcatcgaccggctgggcaacgtcatcgagttcaacgggaagcgcctctga

SEQ ID NO: 2274 - RNA, 4539 nt, synthetic construct
  misc_feature 1..4539: note = Cas9 variant
  source 1..4539: mol_type = other RNA
atgaagaacatcctgggcctcgacctggggaccaacagcatcggctgggccgtgatcaacagcgaggaggacgggcccatcgtcaagaagcgcatcgagctggccggcagccggatcatcccgatggacgcggccgtgctcgggaacttcgactccggcgtgaccaagagccagacggccgagcgcacctccttccggagcatccgccggctgcgcgagcggcagctgctccgccgggagcgcctgcacaaggtcctgcagatcctcggcttcctgcccgagcactacgtgaacgacatcgacttcgagaaccaccccgggaagatcaagcggaacaccgagcccaagctgccgtggcgcaagaactccatgggccagttcgagttcatcttccaggacagcttcgaggccatgctcaccgacttcgccacgcaccagcccgtgttcgtctccgaggggaagaaggtgccctacgactggaccctgtactacctgcggaagaaggcgctcaccgagggcatcagcaaggaggagctggcctggctgatcctcaacttcaaccagaagcgcgggtactaccagctgcggggcgaggaggaggaggagcagtccaacaagctggtggagttctacgccctccgcgtcgtgaaggtggaggccaccgacgacaagaagggcaaggacacgtggtacaacgtccacctggagaacgggtggatctaccggcgcaccagcaacatccccctggactgggagggcaaggtgaaggagttcatcgtgaccaccgacctcaacgaggacgggacgccgaagctggacaagtacggcgaggtcaagcggtccttccgcgcgcccaaggaggacgactggaccctgatcaagaagaagaccgagagcgacatcgccaactcccacaagaccgtgggctgctacatctacgacgccctcctgcagaacccccaccagaagatcaaggggcggctggtgcgcacggtcgagcgcaagttctacaaggaggagctccggctgatcctggagaagcagctcagcttccaccccgagctgcaggaccgcgacctgtaccgggcctgcatcgacgccctctacgtgtccaacgaggcgcacaagaacaacatcagcggccgcgacttcgtgtacctgttcatcgacgacatcatcttctaccagcggccgctgaagaccaagaagtccctcatcgacaactgcccctacgaggagaaccagtacatggaccgcgagaccggggaggtcaagcaggcccccatcaagtgcatcgccaagagccaccccctgttccaggagttccggctgtggcagttcatcagcaacatccgcatctaccagcgggagcgcgtgctcgacgacggcaagctggagaccgacgtggacgtcacgccggacttcctgaagaccgaggacgactacaccaccctcttcgagtggttcaacgaccggaaggaggtggaccagaaggccttcctgaagaacccccagttcgggctgaagaagacgttcaccgagtaccgctggaactacgtcgaggacaagtcctacccctgcaacgagacccggaacgccatcctcaacggcctgcagaaggcgggcgtgagcgccgacttcctgtcccgcgaggtggaggaggccctgtggcacatcctctacagcgtcgaggacaagatcgagatcgagtccgccctgcggaagttcgccagcaagcacgacctggacgaccgcttcgcggacgtgttcaagaagctgcccccgttcaagaaggagtacggggcctactccgccaaggccatcaagaagctgctgcccctcatgcggatcggcaagtactgggagctgagcaacatcgacgacaagaccaaggagcgcatcgacaagatcatcacgggggagtgggacgagaacatccacgaccgggtgcgcgagaaggccatcaagctgtccgacatcaccgacttcaagggcctccccctgtggctgagctgctacgtcgtgtacaaccgccactccgaggcgcgggccatcgccaagtgggagagccccgaggacatcgactcctacctccgcctgttccggcagcacagcctgcgcaacccgatcgtggagcaggtcatcaccgagaccctccggacggtgcgcgacatctggaagcgggtggggcagatcgacgagatccacgtcgagctgggccgcgagatcaagaaccccgccgacaagcgggcgaagatgaccgcccagatcgtggagaacgagaacaccaacctgcgcatcaaggccctcctggccgagttcatcaactccgagtacgagatcgagaacgtgcggccctacagctccaaccagcaggagaagctgaagatctacgaggacaccgtcctcaacggcgtgaaggagatccccgaggacatcaacacgatcctgaagaagttccgcgagagcgacctgaagaagcggccgaccaagtccgacttcctccactacaagctgtggctggagcagaagtactgcagcccctacaccgggcgcatcatccccctcggcaagctgttcaccagcgcctacgagatcgagcacatcatcccgcaggcgcactacttcgacgactccttcagcaacaaggtgatctgcgaggccgaggtcaacgggctgaaggacaagaagctcggctacgagttcatcaagcacaaccccgggaagatggtggagatcggcttcggcaagccgcccgtgcggatcttctccgtcgaggagtacgagcgcttcgtgaaggagaactacagcgggatcaagaacaagatgaacaagctgctgatggacgacatccccgagaccttcatcgagcggcagctcaacgactcccgctacatcagcaaggtggtcaagtccctgctgagcaacatcgtgcgggagaaggactccaacggcgagtacgagcccgaggccatcagcaagaacgtgatcgtctgcacggggtccgtgaccgaccgcctcaagcgggactggggcgtgaacgacgtctggaacagcatcatctacccccgcttcgagcgcctgaacgagctgaccggctcccagcagttcgggtgctgggagaacaaggagggcaagcgggtgttccagaccgccgtgcccctcgagatgcagaaggggttcagcaagaagcgcatcgaccaccggcaccacgccatggacgcgatcgtcatcgcctgcgccacgcgcaaccacatcaactacctgtccaacgagagcgcctccaagaaggccaagatcagccggaccgacctgcagcgcctcctgtgcaccaagtgccggaccgacgacaacggcaactacaagtggatcgtgaagaagccgtggcccgcgttcacgcaggacatccgcaaggccctggagaacatcaccgtgagcttcaagcagaacctccgggtcatcaacaagaccaccaactactacgtgcacttcgacgagtccgggaagaaggtgctggagaagcagatcaacggcgacagctgggccatccgcaagcccatgcacaaggacacggtcttcggcaaggtgaacctgcagaaggtgaaggaggtccggctctccctggccctggacacccccaagatgatcgtggacaagaagctcaaggagaaggtgctgcagctgtacagctacaagtacgacaagaagcgcatcgacaagtacttcaaggagaacgcgtccctctggaaggacctgaacctgagcaaggtcgccgtgtactacttcaccaacgactccaccgagccgctcgtggccgtccggaagcccctggacacgagcttcaacgccaagaagatcaaggagtccgtgaccgacaccgggatccagaagatcctgctcaaccacctgagcaacaaccaggacgaccccaacctggccttctcccccgacggcatcgacaagatgaacaagaacctcaccgcgctgaacgacgggaagtaccaccagccgatctacaaggtgcgcgtctgcgagccccagggcaacaagttcagcgtggggacgtccggcaacaagaccagcaagtacgtcgaggccgccaagggcaccaacctgttcttcgccgtgtaccagaccgaggacgggaagcggtcctacgagacgatccccctcaacgtggtcatcgagcgcgagaagctgggctggacccccgtgccggagaacaacaacaacggggacaagctcctcttctggctgagccccaacgacctggtgtacgtccccaccgccgacgagctcaacaacggcatgcggctggacaacatggacaaggggcgcatctacaagatgatctcctgcagcggcccccagtgcttcttcatcccgcagaacgtgtccaacgcgatcatccccgtgatcgagctgggcgccaacaacaaggccgagaagtcctggaacaacgagatgatcaaggtcgtgtgcgtgcccatccgggtcgaccgcctcgggtgcatcacccagatcaacaaccagaagtga

SEQ ID NO: 2275 - RNA, 4551 nt, synthetic construct
  misc_feature 1..4551: note = Cas9 variant
  source 1..4551: mol_type = other RNA
atgaagaacatcctgggcctcgacctggggaccaacagcatcggctggtccgtgatccaggagaagcacaacgagaacaacgagtgccagaagctgatcctcggggccggcagccgcatcatccccatggacgccgcggtcctgggggacttcgccaagggcaacaccatctcccagacgaaggaccggacccagtaccgcggcgtgcggcgcctgcgggagcgctgcctcctgcggcgcgagcggctgttccgcgtgctcgacatcatggggttcctgccgcagcacttcagcaacgccctgacccggtacggcaagttcaaggacgccgacgaggagcccaagatcgcctggcgcaaggacgacgaggggaagatgcacttcctcttcgcggactccttcaacgagatgatcgaggagttccggagcgtccagcccgagctgctgaagcgcggcatgaaggtgccctacgactggaccctctactacctgcggaagaaggccatgcgcgaggccgtgacgccgttcgagctggcctggctcatcctgtccttcaaccagaagcgggggtactaccagctgcgcggcgaggaggagggcgaggcggacaacagcaagtccgaggagtacctcgcccagcgggtcgtggacgtgatcgacaccggggagaagaagggcaagagcacctggttcgacatcgtcctggagaacgggatggtgtaccaccgccccgccgagatcaagcccgactggatcggcaagaccaaggagttcatcgtgacgacccagttcgacaaggacggcaaccccaagaaggacaaggaggggaacgtcaagatgtccttccggatgccgaacgagaacgactggaacctgcagaagaagaaggccgagaaggacatcgacgagagcggcatgaccgtgggggagtacatctacaacgccctcctgcacaaccccaagcagaagatcaagggcaagctggtgcgcgtcgtggagcgcaagtactacaagaacgagctccagaagatcctggagtcccagaagcggttcatcccccagctgagcgactccgcgctctacgagaagtgcatcaaggagctgtaccagagcaacgaggcctaccgcaactccatcagcacccggaacgacttcacgtacctgttcgtggacaacatcatcttctaccagcgccccctcaagtccaagaagtccctgatcgacaactgcccgtacgagagcctggcctacaccaaggacggggaggagcacaaggcccccgtcaagtgcatcgccaagagccaccccctctaccaggagttccggctgtggcagttcatcagcaacctgcgcatctaccagcggcagaagcaggtcggcgacaaggtgaagctcgacgtggacgtgaccgacgagttcctgcccaccgacgaccgccgggagtccctgttcgactacctcaacgacaagacggagatcaagcaggacgtgctgctgaaggagttcttcagcatgaagaagccgaagggcaaggactccgtctacccctaccgctggaactacgtggaggacaagagctacccctgcaacgtcacccgggggaagatcctcgcgaagctgaaccgcgccggcatctccgccgacttcctgagctccaacgggaacgaggagagcctctggcacatcctgtactccgtggaggacaagggcgagctgcggaaggccctggcccgcttcgcggccaagaacgggctcgacgacgccttcaccgaggccctggccgacatcgagccctacaagaaggagtacggcgcgtacagcgccaaggccctgaagaagctcctgccgctgatgcggctcggcaagtactggaactacgacaacatcgcccccgcgaccaaggcccgcatctccaagatcatcgacggggagtacgacgagaacatccggaaccgcgtgcgggagaaggccatgagcctgaactccgccagccagttccagggcctgcccctctggctggcctgctacatcgtctacgaccgccactccgagcgcgcggacagcgggcggtggtccagccccgaggacatcgacaagtacctgagcgacttcaagcagcactccctccgcaacccgatcgtggagcaggtcgtgacggagaccctgcggaccgtgcgcgacatctggaagcggtacggcgagatcagcgagatccacgtggagctggggcgcgagatgaagaaccccgccgacaagcggtccaagatgaaccgccggatgctcgagaacgagaacgccaacatgcgcgccaagctgctgctcaccgagttcatgaaccccgagttcggcatcgagaacgtccggagctactcccccagccagcaggagctgctgcgcatctacgaggacggcgccatctccaacgcggggagcgagatcgacgacgagatctccgacatcatgagccggctctcccaggtggacgtgaagaagcagccgacggccagcgaggtcaagcgctacatcctgtggctggagcagaactaccggtccccctacaccggccagatgatccccctcgccaagctgttcaccccggcctacgagatcgagcacgtgatcccccagagccgctacttcgacgactccttcagcaacaaggtgatctgcgaggccgaggtcaacaagctgaaggaccggatgctcgggtacgagttcatcaagcagcacaagggcgagaaggtgtccctgagcatgggcgggaccgtggagatcctgagccccgaggagtacgtccgccacgtggagtcccagtacaagaacaacaaggcgaagatgcggaagctcctgatggacgacatccccgacgagttcatcaaccgccagctgaacgacagccggtacatctccaagctcatcatcagcctgctgtccaacatcgtgcgcgaggagggcgaggaggaggccacgagcaagaacgtcatctcctgcaacgggagcatcaccgaccgcctcaagaaggactggggcatcaacgacgtgtggaaccacatcatcctgccgcggttccgccggctgaacgagctcaccgggaccgacaagttcacgacctccaacaaggagggccacgaggtgcccgagatgcccctggagctgcagaagggcttcaacaagaagcgcatcgaccaccggcaccacgccatggacgccatcgtcatcgcgtgcatcacccgcgaccacgtgaacctcctgaacaacgaggccgccatgagcaagaacaacgccaaccggatccagctgtccaagaagctccgccggtacgagagcgtggagatcgagaaggacgggatccgcaagcagatctccatggccaaggagttcaagaagccctgggagggcttcaccgcggacgtcgagcggacgctgcgcgacatcgtggtgagcttcaagcagaacctgcgggtcatcaacaagaccaccaactactaccagcacttcaaggacgggaagaagatctactccccgcagagcaagggcgactcctgggccatccgcaagagcatgcacaaggagaccgtgttcggggagatcaacatccggcgcatcaaggaggtgtccctcaaggaggccatgaagcggatcaaggacatcgccgacaaggagctgcgcagcaagatcgtcgagctgatggccctccagtacaacgagaagaagatcaagcagtacttcagcgacaacaaggacgagtggtccgacgtgaaccccaagaagatcaagatccactacttcaccaaggagacgaacgagcggttcttcgcgacccgcaagcccctggacaccagcttcgacaagaagaagatcaagacccaggtggccgacacggccatccagaagatcctgctcaaccacctgtccgcccacggcgacaaggccgagaccgcgttcagccccgacggcatcgacgagatgaaccgcaacatcatcgagctgaacgacgggaagttccaccagccgatcctcaaggtccggatctacgagaaggccgacaagtacgccgtgggccagcaggggaacaagaagaagaagtacgtggaggccgcgaagggcaccaacctgttcttcgccatctacgccgaggagaagatcgacgagaagaccggggacacggtcatcacccgcacctacgactccatccccctgaacgtggtgatcgaccgggagaagcgcggcctcagccccgtccccgagaacgagaacggcgccaagccgaagtacgtgctgtcccccaacgacctggtgtacgtccccaacgaggaggagcgggagaccgggcgcatctgcgagcccctcgacaaggagcggatctacaagatggtgagctccaacaagaagcaggccttcttcatcaagagcgaggtggcgtccacgatcgtcgacaagttcgagttcagcgccctgaacaagcaggagcgcgccctgtccggcgagatgatcaaggagatctgcatcccgatcagcatcaaccggatcggggagatcaccctccgctga

SEQ ID NO: 2276 - RNA, 4554 nt, synthetic construct
  misc_feature 1..4554: note = Cas9 variant
  source 1..4554: mol_type = other RNA
atgaagaagatcgtgggcctggacctcgggaccaacagcatcggctgggccctgatcaacgcctacatcaacaaggagcacctgtacgggatcgaggcgtgcggctcccgcatcatccccatggacgccgccatcctcgggaacttcgacaagggcaacagcatctcccagaccgccgaccggacgagctaccgcggcatccggcgcctgcgggagcgccacctcctccggcgcgagcggctgcaccgcatcctggacctcctggggttcctgccgaagcactactccgacagcctcaaccggtacggcaagttcctgaacgacatcgagtgcaagctgccctgggtcaaggacgagaccgggtcctacaagttcatcttccaggagagcttcaaggagatgctcgccaacttcaccgagcaccaccccatcctgatcgcgaacaacaagaaggtgccctacgactggaccatctactacctgcgcaagaaggccctcacgcagaagatctccaaggaggagctggcctggatcctgctcaacttcaaccagaagcggggctactaccagctgcgcggggaggaggaggagaccccgaacaagctggtggagtactacagcctcaaggtcgagaaggtggaggactccggcgagcggaagggcaaggacacctggtacaacgtgcacctggagaacgggatgatctaccgccggaccagcaacatccccctggactgggagggcaagacgaaggagttcatcgtcaccaccgacctcgaggccgacgggtcccccaagaaggacaaggagggcaacatcaagcgcagcttccgggcgcccaaggacgacgactggaccctgatcaagaagaagacggaggccgacatcgacaagatcaagatgaccgtgggcgcctacatctacgacaccctgctccagaagccggaccagaagatccgcgggaagctggtgcggaccatcgagcgcaagtactacaagaacgagctgtaccagatcctcaagacgcagtccgagttccacgaggagctgcgcgacaagcagctgtacatcgcctgcctcaacgagctgtaccccaacaacgagccccggcgcaacagcatctccacccgggacttctgccacctgttcatcgaggacatcatcttctaccagcgccccctcaagagcaagaagtccctgatcgacaactgcccgtacgaggagaaccggtacatcgacaaggagagcggcgagatcaagcacgccagcatcaagtgcatcgcgaagtcccaccccctgtaccaggagttccgcctctggcagttcatcgtcaacctgcggatctaccgcaaggagaccgacgtggacgtgacccaggagctgctccccacggaggccgactacgtcaccctgttcgagtggctgaacgagaagaaggagatcgaccagaaggccttcttcaagtacccgcccttcgggttcaagaagaccaccagcaactaccggtggaactacgtggaggacaagccctacccctgcaacgagacgcacgcccagatcatcgcccgcctcggcaaggcgcacatccccaaggccttcctgtccaaggagaaggaggagaccctgtggcacatcctgtacagcatcgaggacaagcaggagatcgagaaggccctccactccttcgccaacaagaacaacctgagcgaggagttcatcgagcagttcaagaacttcccgcccttcaagaaggagtacgggtcctacagcgccaaggcgatcaagaagctgctccccctgatgcggatgggcaagtactggtccatcgagaacatcgacaacggcacccgcatccggatcaacaagatcatcgacggggagtacgacgagaacatccgcgagcgggtgcgccagaaggccatcaacctgaccgacatcacgcacttccgggccctccccctgtggctggcctgctacctcgtctacgaccgccacagcgaggtgaaggacatcgtgaagtggaagaccccgaaggacatcgacctgtacctgaagtccttcaagcagcacagcctccggaaccccatcgtcgagcaggtcatcaccgagaccctgcgcacggtgcgcgacatctggcagcaggtcggccacatcgacgagatccacatcgagctggggcgggagatgaagaaccccgccgacaagcgcgcgcggatgtcccagcagatgatcaagaacgagaacaccaacctccgcatcaaggccctgctgaccgagttcctcaaccccgagttcggcatcgagaacgtgcggccgtacagcccctcccagcaggacctgctgcgcatctacgaggagggggtgctcaacagcatcctggagctgcccgaggacatcggcatcatcctcggcaagttcaaccagaccgacacgctgaagcggccgacccgctccgagatcctgcggtacaagctctggctggagcagaagtaccgcagcccctacaccggggagatgatccccctgtccaagctgttcacccccgcctacgagatcgagcacatcatcccgcagagccggtacttcgacgacagcctgtccaacaaggtgatctgcgagagcgagatcaacaagctgaaggaccgctccctcggctacgagttcatcaagaaccaccacggggagaaggtggagctggccttcgacaagcccgtcgaggtgctgagcgtggaggcgtacgagaagctcgtccacgagtcctacagccacaaccggtccaagatgaagaagctgctgatggaggacatccccgaccagttcatcgagcgccagctcaacgacagccggtacatctccaaggtggtcaagagcctgctgtccaacatcgtgcgcgaggagaacgagcaggaggccatcagcaagaacgtgatcccctgcaccggcgggatcacggaccggctcaagaaggactggggcatcaacgacgtgtggaacaagatcgtcctgccgcgcttcatccggctgaacgagctcaccgagtccacccgcttcaccagcatcaacacgaacaacaccatgatcccctccatgcccctggagctgcagaagggcttcaacaagaagcggatcgaccaccgccaccacgccatggacgccatcatcatcgcctgcgcgaaccgcaacatcgtgaactacctcaacaacgtgagcgcctccaagaacaccaagatcacccggcgcgacctgcagacgctgctctgccacaaggacaagaccgacaacaacgggaactacaagtgggtcatcgacaagccctgggagaccttcacccaggacacgctgaccgccctgcagaagatcaccgtgagcttcaagcagaacctccgggtgatcaacaagaccacgaaccactaccagcactacgagaacggcaagaagatcgtcagcaaccagtccaagggggacagctgggccatccgcaagtccatgcacaaggagaccgtgcacggcgaggtgaacctgcggatgatcaagaccgtcagcttcaacgaggccctgaagaagccgcaggcgatcgtggagatggacctcaagaagaagatcctggccatgctggagctcggctacgacaccaagcgcatcaagaactacttcgaggagaacaaggacacgtggcaggacatcaacccctccaagatcaaggtgtactacttcaccaaggagaccaaggaccggtacttcgccgtccgcaagcccatcgacaccagcttcgacaagaagaagatcaaggagtccatcacggacaccgggatccagcagatcatgctgcggcacctggagaccaaggacaacgaccccaccctcgccttcagcccggacggcatcgacgagatgaaccgcaacatcctgatcctgaacaaggggaagaagcaccagcccatctacaaggtgcgggtgtacgagaaggccgagaagttcacggtcggccagaaggggaacaagcgcaccaagttcgtggaggcggccaagggcaccaacctcttcttcgccatctacgagaccgaggagatcgacaaggacacgaagaaggtgatccggaagcgctcctacagcaccatccccctgaacgtcgtgatcgagcggcagaagcagggcctgtccagcgcccccgaggacgagaacgggaacctcccgaagtacatcctgtcccccaacgacctggtgtacgtccccacccaggaggagatcaacaagggcgaggtggtgatgcccatcgaccgcgaccggatctacaagatggtcgacagctccgggatcaccgcgaacttcatcccggccagcacggccaacctcatcttcgccctgcccaaggccaccgcggagatctactgcaacggcgagaactgcatccagaacgagtacgggatcggcagcccccagtccaagaaccagaaggccatcaccggcgagatggtgaaggagatctgcttcccgatcaaggtggaccgcctggggaacatcatccaggtcggctcctgcatcctcaccaactga

SEQ ID NO: 2277 - RNA, 4563 nt, synthetic construct
  misc_feature 1..4563: note = Cas9 variant
  source 1..4563: mol_type = other RNA
atgaagaagatcgtgggcctggacctcgggaccaacagcatcggctgggccctgatcaacgcctacatcgacgagtacaacaaggagcacctgtacgggatcgaggcgtgcggctcccgcatcatccccatggacgccgccatcctcgggaacttcgacaagggcaacagcatctcccagaccgccgaccggacgagctaccgcggcatccggcgcctgcgggagcgccacctcctccggcgcgagcggctgcaccgcatcctggacctcctggggttcctgccgaagcactactccgacagcctcaaccggtacggcaagttcctgaacgacatcgagtgcaagctgccctgggtcaaggacgagaccgggtcctacaagttcatcttccaggagagcttcaaggagatgctcgccaacttcaccgagcaccaccccatcctgatcgcgaacaacaagaaggtgccctacgactggaccatctactacctgcgcaagaaggccctcacgcagaagatctccaaggaggagctggcctggatcctgctcaacttcaaccagaagcggggctactaccagctgcgcggggaggaggaggagaccccgaacaagctggtggagtactacagcctcaaggtcgagaaggtggaggactccggcgagcggaagggcaaggacacctggtacaacgtgcacctggagaacgggatgatctaccgccggaccagcaacatccccctggactgggagggcaagacgaaggagttcatcgtcaccaccgacctcgaggccgacgggtcccccaagaaggacaaggagggcaacatcaagcgcagcttccgggcgcccaaggacgacgactggaccctgatcaagaagaagacggaggccgacatcgacaagatcaagatgaccgtgggcgcctacatctacgacaccctgctccagaagccggaccagaagatccgcgggaagctggtgcggaccatcgagcgcaagtactacaagaacgagctgtaccagatcctcaagacgcagtccgagttccacgaggagctgcgcgacaagcagctgtacatcgcctgcctcaacgagctgtaccccaacaacgagccccggcgcaacagcatctccacccgggacttctgccacctgttcatcgaggacatcatcttctaccagcgccccctcaagagcaagaagtccctgatcgacaactgcccgtacgaggagaaccggtacatcgacaaggagagcggcgagatcaagcacgccagcatcaagtgcatcgcgaagtcccaccccctgtaccaggagttccgcctctggcagttcatcgtcaacctgcggatctaccgcaaggagaccgacgtggacgtgacccaggagctgctccccacggaggccgactacgtcaccctgttcgagtggctgaacgagaagaaggagatcgaccagaaggccttcttcaagtacccgcccttcgggttcaagaagaccaccagcaactaccggtggaactacgtggaggacaagccctacccctgcaacgagacgcacgcccagatcatcgcccgcctcggcaaggcgcacatccccaaggccttcctgtccaaggagaaggaggagaccctgtggcacatcctgtacagcatcgaggacaagcaggagatcgagaaggccctccactccttcgccaacaagaacaacctgagcgaggagttcatcgagcagttcaagaacttcccgcccttcaagaaggagtacgggtcctacagcgccaaggcgatcaagaagctgctccccctgatgcggatgggcaagtactggtccatcgagaacatcgacaacggcacccgcatccggatcaacaagatcatcgacggggagtacgacgagaacatccgcgagcgggtgcgccagaaggccatcaacctgaccgacatcacgcacttccgggccctccccctgtggctggcctgctacctcgtctacgaccgccacagcgaggtgaaggacatcgtgaagtggaagatcccgaaggacatcgacctgtacctgaagtccttcaagcagcacagcctccggaaccccatcgtcgagcaggtcatcaccgagaccctgcgcaccgtgcgcgacatctggcagcaggtcggccacatcgacgagatccacatcgagctggggcgggagatgaagaaccccgccgacaagcgcgcgcggatgtcccagcagatgatcaagaacgagaacacgaacctccgcatcaaggccctgctgaccgagttcctcaaccccgagttcggcatcgagaacgtgcggccgtacagcccctcccagcaggacctgctgcgcatctacgaggagggggtgctcaacagcatcctggagctgcccgaggacatcggcatcatcctcggcaagttcaaccagaccgacaccctgaagcggccgacgcgctccgagatcctgcggtacaagctctggctggagcagaagtaccgcagcccctacaccggggagatgatccccctgtccaagctgttcacccccgcctacgagatcgagcacatcatcccgcagagccggtacttcgacgacagcctgtccaacaaggtgatctgcgagagcgagatcaacaagctgaaggaccgctccctcggctacgagttcatcaagaaccaccacggggagaaggtggagctggccttcgacaagcccgtcgaggtgctgagcgtggaggcgtacgagaagctcgtccacgagtcctacagccacaaccggtccaagatgaagaagctgctgatggaggacatccccgaccagttcatcgagcgccagctcaacgacagccggtacatctccaaggtggtcaagagcctgctgtccaacatcgtgcgcgaggagaacgagcaggaggccatcagcaagaacgtgatcccctgcaccggcgggatcaccgaccggctcaagaaggactggggcatcaacgacgtgtggaacaagatcgtcctgccgcgcttcatccggctgaacgagctcacggagtccacccgcttcaccagcatcaacaccaacaacacgatgatcccctccatgcccctggagctgcagaagggcttcaacaagaagcggatcgaccaccgccaccacgccatggacgccatcatcatcgcctgcgcgaaccgcaacatcgtgaactacctcaacaacgtgagcgcctccaagaacaccaagatcacccggcgcgacctgcagaccctgctctgccacaaggacaagacggacaacaacgggaactacaagtgggtcatcgacaagccctgggagaccttcacccaggacaccctgacggccctgcagaagatcaccgtgagcttcaagcagaacctccgggtgatcaacaagaccaccaaccactaccagcactacgagaacggcaagaagatcgtcagcaaccagtccaagggggacagctgggccatccgcaagtccatgcacaaggagacggtgcacggcgaggtgaacctgcggatgatcaagaccgtcagcttcaacgaggccctgaagaagccgcacgcgatcgtggagatggacctcaagaagaagatcctggccatgctggagctcggctacgacaccaagcgcatcaagaactacttcgaggagaacaaggacacctggcaggacatcaacccctccaagatcaaggtgtactacttcacgaaggagaccaaggaccggtacttcgccgtccgcaagcccatcgacaccagcttcgacaagaagaagatcaaggagtccatcaccgacacggggatccagcagatcatgctgcggcacctggagaccaaggacaacgaccccaccctcgccttcagcccggacggcatcgacgagatgaaccgcaacatcctgatcctgaacaaggggaagaagcaccagcccatctacaaggtgcgggtgtacgagaaggccgagaagttcaccgtcggccagaaggggaacaagcgcacgaagttcgtggaggcggccaagggcaccaacctcttcttcgccatctacgagaccgaggagatcgacaaggacaccaagaaggtgatccggaagcgctcctacagcacgatccccctgaacgtcgtgatcgagcggcagaagcagggcctgtccagcgcccccgaggacgagaacgggaacctcccgaagtacatcctgtcccccaacgacctggtgtacgtccccacccaggaggagatcaacaagggcgaggtggtgatgcccatcgaccgcgaccggatctacaagatggtcgacagctccgggatcaccgcgaacttcatcccggccagcaccgccaacctcatcttcgccctgcccaaggccacggcggagatctactgcaacggcgagaactgcatccagaacgagtacgggatcggcagcccccagtccaagaaccagaaggccatcaccggcgagatggtgaaggagatctgcttcccgatcaaggtggaccgcctggggaacatcatccaggtcggctcctgcatcctcaccaactga

SEQ ID NO: 2278 - RNA, 4563 nt, synthetic construct
  misc_feature 1..4563: note = Cas9 variant
  source 1..4563: mol_type = other RNA
atgaagaagatcgtgggcctggacctcgggaccaacagcatcggctgggccctgatcaacgcctacatcgacgagtacaacaaggagcacctgtacgggatcgaggcgtgcggctcccgcatcatccccatggacgccgccatcctcgggaacttcgacaagggcaacagcatctcccagaccgccgaccggacgagctaccgcggcatccggcgcctgcgggagcgccacctcctccggcgcgagcggctgcaccgcatcctggacctcctggggttcctgccgaagcactactccgacagcctcaaccggtacggcaagttcctgaacgacatcgagtgcaagctgccctgggtcaaggacgagaccgggtcctacaagttcatcttccaggagagcttcaaggagatgctcgccaacttcaccgagcaccaccccatcctgatcgcgaacaacaagaaggtgccctacgactggaccatctactacctgcgcaagaaggccctcacgcagaagatctccaaggaggagctggcctggatcctgctcaacttcaaccagaagcggggctactaccagctgcgcggggaggaggaggagaccccgaacaagctggtggagtactacagcctcaaggtcgagaaggtggaggactccggcgagaagaagggcaaggacacctggtacaacgtgcacctggagaacgggatgatctaccggcgcaccagcaacatccccctggactgggagggcaagacgaaggagttcatcgtcaccaccgacctcgaggccgacgggtcccccaagaaggacaaggagggcaacatcaagcggagcttccgcgcgcccaaggacgacgactggaccctgatcaagaagaagacggaggccgacatcgacaagatcaagatgaccgtgggcgcctacatctacgacaccctgctccagaagccggaccagaagatccgggggaagctggtgcgcaccatcgagcggaagtactacaagaacgagctgtaccagatcctcaagacgcagtccgagttccacgaggagctgcgcgacaagcagctgtacatcgcctgcctcaacgagctgtaccccaacaacgagccccgccggaacagcatctccacccgcgacttctgccacctgttcatcgaggacatcatcttctaccagcggcccctcaagagcaagaagtccctgatcgacaactgcccgtacgaggagaaccgctacatcgacaaggagagcggcgagatcaagcacgccagcatcaagtgcatcgcgaagtcccaccccctgtaccaggagttccggctctggcagttcatcgtcaacctgcgcatctaccggaaggagaccgacgtggacgtgacccaggagctgctccccacggaggccgactacgtcaccctgttcgagtggctgaacgagaagaaggagatcgaccagaaggccttcttcaagtacccgcccttcgggttcaagaagaccaccagcaactaccgctggaactacgtggaggacaagccctacccctgcaacgagacgcacgcccagatcatcacccggctcggcaaggcccacatccccaaggcgttcctgtccaaggagaaggaggagaccctgtggcacatcctgtacagcatcgaggacaagcaggagatcgagaaggccctccactccttcgccaacaagaacaacctgagcgaggagttcatcgagcagttcaagaacttcccgcccttcaagaaggagtacgggtcctacagcgccaaggccatcaagaagctgctccccctgatgcgcatgggcaagtactggtccatcaagaacatcgacaacggcacccggatccgcatcaacaagatcatcgacggggagtacgacgagaacatccgggagcgcgtgcggcagaaggcgatcaacctgacggacatcacccacttccgcgccctccccctgtggctggcctgctacctcgtctacgaccggcacagcgaggtgaaggacatcgtgaagtggaagaccccgaaggacatcgacctgtacctgaagtccttcaagcagcacagcctccgcaaccccatcgtcgagcaggtcatcaccgagacgctgcggaccgtgcgcgacatctggcagcaggtcggccacatcgacgagatccacatcgagctggggcgcgagatgaagtcccccgccgacaagcgggcccgcatgagccagcagatgatcaagaacgagaacaccaacctccggatcaaggcgctgctgaccgagttcctcaaccccgagttcggcatcgagaacgtgcgcccgtactcccccagccagcaggacctgctgcggatctacgaggagggggtgctcaactccatcctggagctgcccgaggacatcggcatcatcctcggcaagttcaaccagacggacaccctgaagcgcccgacccggagcgagatcctgcgctacaagctctggctggagcagaagtaccggtccccctacaccggggagatgatccccctgagcaagctgttcacccccgcctacgagatcgagcacatcatcccgcagagccgctacttcgacgactccctgagcaacaaggtgatctgcgagtccgagatcaacaagctgaaggaccggagcctcggctacgagttcatcaagaaccaccacggggagaaggtggagctggccttcgacaagcccgtcgaggtgctgtccgtggaggcctacgagaagctcgtccacgagagctactcccacaaccgcagcaagatgaagaagctgctgatggaggacatccccgaccagttcatcgagcggcagctcaacgactcccgctacatcagcaaggtggtgaagtccctgctgagcaacatcgtccgggaggagaacgagcaggaggcgatctccaagaacgtgatcccctgcacgggcgggatcaccgaccgcctcaagaaggactggggcatcaacgacgtgtggaacaagatcgtcctgccgcggttcatccgcctgaacgagctcaccgagagcacccggttcacgtccatcaacaccaacaacaccatgatccccagcatgcccctggagctgcagaagggcttcaacaagaagcgcatcgaccaccggcaccacgccatggacgccatcatcatcgcctgcgccaaccgcaacatcgtgaactacctcaacaacgtgtccgcgagcaagaacaccaagatcacgcgccgggacctgcagaccctgctctgccacaaggacaagaccgacaacaacgggaactacaagtgggtcatcgacaagccctgggagaccttcacgcaggacaccctgaccgccctgcagaagatcaccgtgagcttcaagcagaacctccgcgtgatcaacaagacgaccaaccactaccagcactacgagaacggcaagaagatcgtctccaaccagagcaagggggactcctgggccatccgcaagagcatgcacaaggagaccgtgcacggcgaggtgaacctgcggatgatcaagaccgtctccctgaacgaggccctcaagaagccgcaggccatcgtggagatggacctgaagaagaagatcctggcgatgctcgagctgggctacgacacgaagcggatcaagaactacttcgaggagaacaaggacacctggcaggacatcaaccccagcaagatcaaggtgtactacttcaccaaggagaccaaggaccgctacttcgccgtccggaagcccatcgacacgtccttcgacaagaagaagatcaaggagagcatcaccgacaccgggatccagcagatcatgctgcgccacctcgagaccaaggacaacgaccccacgctggccttctccccggacggcatcgacgagatgaaccggaacatcctgatcctcaacaaggggaagaagcaccagcccatctacaaggtgcgcgtgtacgagaaggccgagaagttcaccgtcggccagaaggggaacaagcggaccaagttcgtggaggccgcgaagggcaccaacctgttcttcgccatctacgagacggaggagatcgacaaggacaccaagaaggtgatccgcaagcggagctactccaccatccccctgaacgtcgtgatcgagcgccagaagcagggcctcagctccgcccccgaggacgagaacgggaacctgccgaagtacatcctgagccccaacgacctcgtgtacgtccccacccaggaggagatcaacaagggcgaggtggtgatgcccatcgaccgggaccgcatctacaagatggtcgactccagcgggatcacggccaacttcatcccggcgtccaccgccaacctgatcttcgccctgcccaaggccaccgccgagatctactgcaacggcgagaactgcatccagaacgagtacgggatcggcagcccccagtccaagaaccagaaggcgatcaccggcgagatggtgaaggagatctgcttcccgatcaaggtggaccggctcgggaacatcatccaggtcggcagctgcatcctgaccaactga

SEQ ID NO: 2279 - RNA, 4575 nt, synthetic construct
  misc_feature 1..4575: note = Cas9 variant
  source 1..4575: mol_type = other RNA
atgaacaagatcctgggcctcgacctggggaccaacagcatcggctgggccatcgtgcagaaggacgagcaggggttctacgagaagatcatcaacgccggctcccgcatcatccccatggacgcggagaccatgaacaacttcaacaaggggatcaccaagagcccggcctccgagcggacgcgcttccggggcgcccgccggctgatcgagcgcagcctcctgcggcgcgagcggatccaccgcctgctcaacaccatgaactacctgccgccccactacgccgagaagatcgacttcgtcaaccggctgggcaagttcatcggggaggaggagcccaagtacgcctacaaggtggacgagcacggcaagttccagttcatcttcaaggagtccttcaacgagatgctcaaggacttccaggacaagcagcccgagctggtgctgaacaacaagaaggtcccctacgactggaccatctactacctccgcaagaaggcgctgaaccgggccatcagcaaggaggagctggggtggatcatcctccagttcaacaacaagcgcggctactaccagctgcgcggggaggaggacgagacgctgaccgagggccagaagaaggagtacttcgccctcaaggtgatccgggtggaggccgactccagctccgcgggcaagaagggggaggtctggtacaacgtgcagctggagaacggctggatctaccggtgcaagagcgagatccccctggactgggaggggaagatcaaggagttcatcgtgaccaccgaggtcgacgagaacgacaacgtgctcaaggacaaggagggcaaggagaagcgcaagctgaagatccccgaggccggcgactggacgctgctcaagaagaagaccgagtccgacctggacaagagcgggaagaccgtgggcgcctacatctacgacaccctgctctccaacccggaccagaagatcaagggcgggctgatccggacgatcgagcgcgagctgtaccggagcgagctcgagcagatcctggacaagcagaaggagttccaccccgagctgaaggacgggaccctctacaacaagtgcgtcgaggagctgtaccgctccaacgagagccgccggatctccctgagcaactacgacttcacccgcttcatcaccgaggacgtgatcttctaccagcggcccctcaagtccaagaagtccctgatcgacaactgcagcttcgagcgccggaactacctgaaccccatcacgaaggagctcgcctacgccccgatcaagtgcatcgccaagagccaccccctgttccaggagttccgcctgtggcagttcatcaagaacctccggatcatcgagcgcgagaagatcgtgggcgacaagctgatgttcgaccaggacgtcaccaccgagttcctgcccacccagaacgactacgtgatcctcttcgactggctgaacgagcacaaggagatcgaccagaaggcgctgctcaagtaccccgccttcaacctgaagaagaacatcgacaagtaccggtggaactacgtggagaacaagagctacccgtgcaacgagacgcgcgccctgctgaaggccaagctcaacaaggcgggcaacatcccctccgacttcctggacaacgacaccctggagagcctctggcacatcctgtactccgtcgaggacaagttcgagatcgagaaggccctcaagagcttcgccaccaagaaggagctgcgggaggagcagaccgtggccttcgtgaagcagttcatcaacatcccgcccttcaagaaggagtacgggtcctacagcgccaaggcgatcaagaagctgctgcagctcatgcgcatgggctcccggtggagcgagaacgagatctccgacagcacgaaggaccgcatccagaagctgatcgacggggagtgggacgagtccatcaagacccggacccgcgacaaggccatcaagctgaacgagatcaacgacttccagggcctccccctgtggctggccagctacatcgtctacgaccggcactccgagagcggggacgtgatgaagtgggagacccccgaggacatcgactactacctcaagcacgtgttcaagcagcacggcctgcgcaaccccatcgtcgaggtggtcgtggtggagacgctgaaggtcgtgaaggacctctggaagacctacggctacttcaacgagatccacatcgagctggggcgggagatgaagaaccccgccgacaagcgccgctccatgaccaacaagaacatcgagaacgagaacaccaacctgcggatcaaggccctcctggcggagctggccaaccacaaggacgtggagggcgtccgcccgtacagcccctcccagcaggagatcctcaagatctacgaggagggggtgctggacatgctgacgaaggaggaccccgactacgagagcatcagcaagatctccaagatggccctccccagctccagcgagctgatccggtacaagtgctggctggagcagaagtaccgctccccgtacaccggccaggtgatccccctcgcccggctgttcaccagcgagtacgagatcgagcacatcatcccccagtcccgctacttcgacgacagcttctccaacaaggtcatctgcgagagcgcggtgaacaaggacaaggacaacctgctcgcctacgagtacatcaagcagaacgaggggaagatcatcgagatcggcctgggcaagaaggtgaagctgttcaccgccgactcctacacggagttcgtccagagcaactacgtggggtccgtggccaagaagaagaagctcctgatggacaccatcccggacagcttcatcaagcggcagctgaacgactcccgctacatcagccgggagatcatgaagctcctgtccagcgtcgtgcgcgagaaggaggaggaggaggaggaggaggaggaggaggccatcagcaagaacgtgatcgtctgcaccggcgcgatcaccgacaagctgaagcgggagtgggggctcaacgacgtgtggaacaccatcatctacccccgcttcgagcggctgaaccagctgacgaactccgacaagttcggccagtgggagaacaagcagggcaagaaggtgttccagatcgagatgcccctcaagctgcagaaggggttcaacaagaagcgcatcgaccaccggcaccacgccatggacgccatcgtcatcgcctgcgccacccagagccacgtgaactacctgaacaacgagtccgcgcacagcaactccaaggagaagcgctactacctccggcgcaagctgcggcgcatcgagatcctggagaagcaggagctcaaggacggcgtgaccatcaccaagaagatcgaggtcgccaaggagttcaacaagccctggccgacgttcacccaggacgcccacgaggtgctgcagagcatcatcgtgtccttcaagcagaacctgcgggtcgtgaacaaggccaccaaccgctacgcctgcttcgtgaacgggaagaaggagatcgtcaagcagagcaagggcgagtcctgggcgatccgcaagcccatgcacaaggacaccgtgagcgccgccgtgtccctccggaagatcaagacggtcagcctgtcccaggccatcgacgactggaccaacatcgtggacaagagcctgcgcaaggagatcgggctcctgtactccaagtacggccagaacggcagcaagaacatcatcaagtacttcaaggaccgggacaacaagcacaacgggctggacgtgtccaaggtcaacgtgcactacttcgacaacgactacgcggccagccgcgtggccctcgaccacaagttcaactccgccaagatcaagagcatcaccgacaccggcatccagacgatcctgctgaagcacctcgagagctacaacgagatcaacggggacaagatcatcgagcaccccgagctggccttctccgcggacggcctggacatcctcaacgccaacatcaccaagctgaacaacgggaagttccacaagcccatcaagaaggtccggaagaccgagaccctgggcctcaagttcatcgtgggccagacggggaacaagcgcaagaagtacgtggaggccgccgacggcaccaacctgttcttcgccatctacgtcagcgtggacgggatccggtcctacaagaccatcccgctgcgcgaggtggcggagcggctcaaggagggcctgatccccgtccccgagaagaacgacaaggacgaccacctcctgttctggctgagccccggggacctggtgtacgtgccgtccatcgaggaggagggccgcatcgtcgagatcgagaacatcaagcaggaccggatctacaaggtggtgagctgcaccgagaacgagtgccactgcatcccccacttcgtcgcctcccccatcgtgaagacggacgagctcggcgccaacaacaaggcccagcgcgcctggagcggggagatgatcaaggagacctgcatcaagatcaagatgaaccggctgggccagatcgtcaagatctga

SEQ ID NO: 2280 - RNA, 4581 nt, synthetic construct
  misc_feature 1..4581: note = Cas9 variant
  source 1..4581: mol_type = other RNA
atgaagaagatcctgggcctcgacctggggaccaacagcatcggctgggccgtgctgaacgccgcggacgacaactccctcaagtacatcgaggccgccgggagccgcatcatccccatggacgccgccatcctgggcgacttcgaccgggggaactccatcagccagaccgcggagcgcacgcggatccgcggcatgcggcacctccgcgagcggtacctcctgcgccgggcccgcctgcaccggatcctcaacctgctgggcttcctcccgttccactacgcccaggacatcgaccgctacgggaacttctccgccgacatggagcccaagatcgcgtggcggaagaacctggagggcgagctggagttcatcttcatcgagagcttcaacgagatgctcgaggacttccgcaagaaccagcccgagctggtcgccgacaacaagaaggtgccctacgactgggtgatctactacctgcggaagaaggccctcgagaagaagatctccaaggaggagctggcctggatcctgctcaacttcaaccagaagcgcgggtactaccagctgcggggcgaggacgacgacgagagcatgaagaccgccaagacccgccagtacttcgacaagcagatcatcaagaacatcatcgacaccaaccagacgtacaaggggcagcggatcctgatcgtcgagctccagaacggcgacaagggcaagatcttcaagaaggagatcccggactggatcgggcaggagaagaacatcatcgtgaccgtggacatcgacaaggacggcaacgacaagtacgaggagtccgggagcctgtcctgccgcttcaagatccccaccgacgcggagtgggagagcgagtggaagctgatcaagatgaagacccagaaggacctcgacgagtccaacaagacggtcggcacctacatctacgacagcatcctgcagaaccccacccagaaggtgcggggcaagctggtgcgcaccatcgagcgcaagtactacaaggccgagctcaagcagatcctggagaagcagacggagttccactccgagctgcaggacaaggacctctacatcgagtgcctgaacgagctgtacagcaacaacgacacccaccggaacgccatcaccgaccgcgacttcgtctacctcttcatgaacgacatcctgttctaccagcggcccctgaagtccaagaagtccctcatcgacaactgcccgtacgagcgcaacatctacatcgacaaggagaccggggagatcaagtactcccccatcaagtgcatcgccaagagccaccccctgttccaggagttccggctgtggaagttcatcagctccatccgcatctaccagcgggagagcgtggtggaggtcgtggacaagcagctcgacctgttctccagccagtccacgagcgtgcagaagctggtcaccgacgtggacgtgaccgacaagttcctgacctgcgagaacgactacgtcgccctgttcgagtggctgaacaagaagaagatcatcgaccagaaggagttcctcaagtaccgccccttcggcctgaagggggacatcgacaactaccggtggaactacgtggaggacaagtcctacccgtgcaacgagacgcacgcgatgatcctgacctacttcgccaaggccggcatcagcgaggacatcctgaccaaggagatggaggaggccctctggcacatcctgtactccgtggaggaccgccaggagatcaccaaggccctgcggacgttcgcgagcaagtaccacctctccgacagcttcgtcaaggtgttctccaacatcccgcccttcaagaaggagtacgggagctactccgccaaggccatcaagaagctgctgagcctcatgcgcatgggcaagtactggtccgaggacgccatcgacgtgaacacccgggagcgcatcgacaagatcgtcaccggcgagtacgacgagaagatccgggaccgcgtgcgggagaagaccatccgcctgaacgacatccggcacttccgcgccctgcccgactggctcgcgtgctacgtcgtgtacgaccgccacagcgagacgcgggagatcaccgagtggaagtcccccgaggagatcgacgagtacatccgcaacttcaagcagcacagcctgcggaaccccatcgtggagcaggtcatcaccgagaccctgcgcacggtgcgggacatctggaagcaggtcgggtgcatcgacgagatccacgtggagctcggccgcgagatgaagaaccccgccgacaagcggaagcgcatcaccagccagatcatcgagaacgagaacgccaacctgcgggtgaaggccctgctcaccgagttcgtgaaccccgagttcgagatcgagaacgtccgcccgtactccctggggcagcaggacatcctgcggatctacgaggacggcgtgctcaacagcgtggcggaggtccccggggacatcgccggcatcctgaagaagttcaacgagaacgacgccaagaagcgccccaccacgtccgagatcctgcggtacaagctctggctggagcagaagtaccgcagcccctacaccggcgagatgatcccgctgtccaagctgttcaccagcgcctacgagatcgagcacgtgatcccccagtcccggtacttcgacgacagcttctccaacaaggtgatctgcgaggccgaggtcaacaagctcaaggacaacgcgctggggtacgagttcatcaagaagcaccacggcgagaaggtggagctcgggttcggcaagatcgtggagatcttcagcgtctccgtgtacgagcagttcgtgaaggacaactacagccgcaaccgggggaagatgaagaagctgctgatggacgagatccccgagcagttcatcgagcgccagctcaacgactcccggtacatcagcaaggtcgtgaagaccctgctgtccaacgtggtccgcgagaaggccgagcaggaggccgtgagcaagaacgtgatcgtctgcaccggcggcgtgacggaccggctcaagaaggactgggggatcaacgacgtgtggaacaagatcgtcctgccccgcttcctgcgcctcaacgagctgaccaactccaccaacttcaccgccaagaacgccgcgggcaacgagatcccggccatgcccctggagctccagaaggggttcaacaagaagcggatcgaccaccgccaccacgccatggacgccatcgtgatcgcctgcgcgaaccggaacatcgtgaactacctgaacaacgagagcgccagccgcaaggccaagatctcccggcacgacctgcaggccatcctctgcgacaaggtccgcacggacgacaagggcaactaccagtggcgggtgaagaagccctgggacaccttcacccaggacgtgtacgtcgcgctggagaacatcatcgtgagcttcaagcagaacctgcgcgtgatcaacaagacctccaactactactggcactacgagaacggcaagaaggtcctcgtgaagcaggtcaagggggacagctgggccatccggaagccgatgcacaaggacacggtgttcggcgaggtgaacctgcgcaaggtgaagtccgtcagcctgaacgaggccctcaagaacccccagttcatcgtggagaaggacctgaagcggcagctgctctccctgctgcagcagaacttcgacatcaagaagatcaagaagtacttcgaggagcacaaggacatctggagcgacatctccctcagcaagatgaacatctactacttcaccaaggagaccaaggaccgctacttcgccacccggaagcccctggacgcctccttcgacaagaagaagatcgagagctgcatcacggacaccgggatccagcagatcctgctccgccacctggagctgaaggagaacgaccccgagcgggcgttctccccggacggcatcgacgagatgaaccgcaacatcatccagctcaacaaggggaagggccaccaccccatcgccaaggtgcgggtctacgagaaggccgacaagttcgaggtgggccagcgcgggaacaagagctccaagttcgtggaggccgccaagggcaccaacctgttcttcgcggtctacgagaccgagtaccccgacgagaagacgaacagcatcgtgcggaagcgcaactacgccaccatccccctgaacatcgccatcgagcgccagaagcgggggctctccaccgccccggaggacgagaagggcaacgtccccagcttcgtgctgtcccccaacgacctggtgtacctccccaccagcgaggacatcgtcaacgggcacatcacgcagccgatcgacaagagccgcatctacaagatggtgtccagctccggcagccagtgcttcttcatcaagcacaacatcgccaacatcatcgtggacaagtacgagttcagccccctgaacaagatggagcgggcgatcagcaacgagatgatcaaggagatctgcatccccgtcaaggtggaccgcctgggcaacatcgtgaagctcgggaagtccgagtga

SEQ ID NO: 2281 - RNA, 4581 nt, synthetic construct
  misc_feature 1..4581: note = Cas9 variant
  source 1..4581: mol_type = other RNA
atgaagaagatcctgggcctcgacctggggaccaacagcatcggctgggccgtgctgaacgccgcggacgacaactccctcaagtacatcgaggccgccgggagccgcatcatccccatggacgccgccatcctgggcgacttcgaccgggggaactccatcagccagaccgcggagcgcacgcggatccgcggcatgcggcacctccgcgagcggtacctgctgcgccgggcccgcctgcaccggatcctcaacctgctgggcttcctcccgttccactacgcccaggacatcgaccgctacgggaacttctccgccgacatggagcccaagatcgcgtggtgcaagaacctggagggcgagctggagttcatcttcatcgagagcttcaacgagatgctcgaggacttccggaagaaccagcccgagctggtcgccgacaacaagaaggtgccctacgactgggtgatctactacctgcgcaagaaggccctcgagaagaagatctccaaggaggagctggcctggatcctgctcaacttcaaccagaagcgggggtactaccagctgcgcggcgaggacgacgacgagagcatgaagaccgccaagacccggcagtacttcgacaagcagatcatcaagaacatcatcgacaccaaccagacgtacaaggggcagcgcatcctgatcgtcgagctccagaacggcgacaagggcaagatcttcaagaaggagatcccggactggatcgggcaggagaagaacatcatcgtgaccgtggacatcgacaaggacggcaacgacaagtacgaggagtccgggagcctgtcctgccggttcaagatccccaccgacgcggagtgggagagcgagtggaagctgatcaagatgaagacccagaaggacctcgacgagtccaacaagacggtcggcacctacatctacgacagcatcctgcagaaccccacccagaaggtgcgcggcaagctggtgcggaccatcgagcgcaagtactacaaggccgagctcaagcagatcctggagaagcagacggagttccactccgagctgcaggacaaggacctctacatcgagtgcctgaacgagctgtacagcaacaacgacacccaccgcaacgccatcaccgaccgggacttcgtctacctcttcatgaacgacatcctgttctaccagcgccccctgaagtccaagaagtccctcatcgacaactgcccgtacgagcggaacatctacatcgacaaggagaccggggagatcaagtacctgcccatcaagtgcatcgccaagtcccaccccctgttccaggagttccgcctctggaagttcatcagcagcatccggatctaccagcgcgagtccgtggtggaggtcgtggacaagcagctggacctgttcagctcccagagcacgtccgtgcagaagctcgtcaccgacgtggacgtgaccgacaagttcctgacctgcgagaacgactacgtcgccctgttcgagtggctcaacaagaagaagatcatcgaccagaaggagttcctgaagtaccggcccttcggcctgaagggggacatcgacaactaccgctggaactacgtggaggacaagagctacccgtgcaacgagacgcacgcgatgatcctgacctacttcgccaaggccggcatctccgaggacatcctcaccaaggagatggaggaggccctgtggcacatcctgtacagcgtggaggaccggcaggagatcaccaaggccctccgcacgttcgcgtccaagtaccacctgagcgactccttcgtcaaggtgttcagcaacatcccgcccttcaagaaggagtacgggtcctacagcgccaaggccatcaagaagctgctctccctgatgcggatgggcaagtactggagcgaggacgccatcgacgtgaacacccgcgagcggatcgacaagatcgtcaccggcgagtacgacgagaagatccgcgaccgggtgcgcgagaagaccatccggctgaacgacatccgccacttccgggccctccccgactggctggcgtgctacgtcgtgtacgaccgccactccgagacgcgcgagatcaccgagtggaagtcccccgaggagatcgacgagtacatccggaacttcaagcagcacagcctgcgcaaccccatcgtggagcaggtcatcaccgagaccctccggacggtgcgcgacatctggaagcaggtcgggtgcatcgacgagatccacgtggagctgggccgggagatgaagaaccccgccgacaagcgcaagcggatcaccagccagatcatcgagaacgagaacgccaacctgcgcgtgaaggccctcctgaccgagttcgtgaaccccgagttcgagatcgagaacgtccggccgtacagcctgtcccagcaggacatcctccgcatctacgaggacggggtgctgaacagcgtggcggaggtccccggcgacatcgccgggatcctgaagaagttcaacgagaacgacgccaagaagcggcccaccacgtccgagatcctccgctacaagctgtggctggagcagaagtaccggagcccctacaccggcgagatgatcccgctctccaagctgttcaccagcgcctacgagatcgagcacgtgatcccccagtcccgctacttcgacgacagcttctccaacaaggtgatctgcgaggccgaggtcaacaagctgaaggacaacgcgctcggctacgagttcatcaagaagcaccacggggagaaggtggagctgggcttcgggaagatcgtggagatcttcagcgtctccgtgtacgagcagttcgtgaaggacaactacagccggaaccgcggcaagatgaagaagctgctcatggacgagatccccgagcagttcatcgagcggcagctgaacgactcccgctacatcagcaaggtcgtgaagaccctgctctccaacgtggtccgggagaaggccgagcaggaggccgtgagcaagaacgtgatcgtctgcaccgggggcgtgacggaccgcctgaagaaggactggggcatcaacgacgtgtggaacaagatcgtcctgccccggttcctccgcctgaacgagctgaccaactccaccaacttcaccgccaagaacgccgcggggaacgagatcccggccatgcccctcgagctgcagaagggcttcaacaagaagcgcatcgaccaccggcaccacgccatggacgccatcgtgatcgcctgcgcgaaccgcaacatcgtgaactacctgaacaacgagagcgccagccggaaggccaagatctcccgccacgacctccaggccatcctgtgcgacaaggtccggacggacgacaaggggaactaccagtggcgcgtgaagaagccctgggacaccttcacccaggacgtgtacgtcgcgctggagaacatcatcgtgagcttcaagcagaacctccgggtgatcaacaagacctccaactactactggcactacgagaacggcaagaaggtcctggtgaagcaggtcaagggcgacagctgggccatccgcaagccgatgcacaaggacacggtgttcggggaggtgaacctgcggaaggtgaagtccgtcagcctcaacgaggccctgaagaacccccagttcatcgtggagaaggacctgaagcgccagctcctgtccctgctccagcagaacttcgacatcaagaagatcaagaagtacttcgaggagcacaaggacatctggagcgacatctccctgagcaagatgaacatctactacttcaccaaggagaccaaggaccggtacttcgccacccgcaagcccctggacgcctccttcgacaagaagaagatcgagagctgcatcacggacaccggcatccagcagatcctcctgcggcacctggagctcaaggagaacgaccccgagcgcgcgttctccccggacgggatcgacgagatgaaccggaacatcatccagctgaacaagggcaaggggcaccaccccatcgccaaggtgcgcgtctacgagaaggccgacaagttcgaggtgggccagcggggcaacaagagctccaagttcgtggaggccgccaaggggaccaacctgttcttcgcggtctacgagaccgagtaccccgacgagaagacgaacagcatcgtgcgcaagcggaactacgccaccatccccctcaacatcgccatcgagcgccagaagcgcggcctgtccaccgccccggaggacgagaaggggaacgtccccagcttcgtgctgtcccccaacgacctcgtgtacctgcccaccagcgaggacatcgtcaacggccacatcacgcagccgatcgacaagagccggatctacaagatggtgtccagctccgggagccagtgcttcttcatcaagcacaacatcgccaacatcatcgtggacaagtacgagttcagccccctgaacaagatggagcgcgcgatcagcaacgagatgatcaaggagatctgcatccccgtcaaggtggaccggctcggcaacatcgtgaagctgggcaagtccgagtga

SEQ ID NO: 2282 - RNA, 4584 nt, synthetic construct
  misc_feature 1..4584: note = Cas9 variant
  source 1..4584: mol_type = other RNA
atggccaagatcctgggcctcgacctggggaccaacagcatcggctgggccatcgtggagaaggacgggaacgacttctccctggtcgacaagggcgtgcgcatcttcagcgagggggtgaagtccgagaagggcatcgagagctcccgggcggccgagcgcaccggctaccggagcgcccgcaagatcaagtaccggcgcaagctccggaagtacgagacgctgaaggtcctgtccctcaacgggatgtgccccctgagcatcgaggaggtggaggagtggaagaagtccggcttcaaggagtacccgctgaaccccgagttcctcgagtggctgcgcaccagcgacgacgagaacatcaacccctacttcttccgggacaaggcctccaagcagaaggtgaccctgttcgaggtcgggcgcgccttctaccacatcgcgcagcggcgcggcttcctcagcaaccggctggaccagtccgccgaggggatcctggaggagcactgccccaagatcgaggccctcgtggaggacctgaacagcaccgacgagatcctgacgtccctcaaggactacttcttcgacaccggcatcctggacgccaacgagaagggcgggttcgcgaaggacctggacgagggcgacaagaagctcgtgagcctgtaccgctccatccaggccatcgtcaagaagaacgacaccgacttcgagaaggggaaggccgagatcatcgagcggctgaacaagaaggacgtgctcggcaaggtgaagggcaagatcaaggacatcagccaggccatgctggaggggaacttcaagaccctgggccagtacttcttctccctctacaacaaggagcgcatccggaaccagtacacgagccgcgaggaccactacctggaggagttcaagatcatctgcaagttccaggggatcggcagcatcaaccagaacgagaagctgccggagaagaagttcgaggggctcgccaaggagctgtacaaggcgatcttcttccagcggcccctgaagtcccagaagggcctcatcggcaagtgcagcttcgagaagtccaagagccgctgcgccatctcccaccccgacttcgaggagaagcggatgtgggagtacctgaacaccatcaagatcgggacccagagcgagaaggtcctgcgcttcctctcccaggaggagaagctgaacctgatccccaagttcctccgcaagaaggacaacttcaacttcgaggacctggccaaggagctgatcgagaagggcgccaccttcgggttctacaagagctccaagcgggacagcttccactactggttcaactacaagccgacggacaccgtgtccggctgccccgtgagcgcctccctcaagagcgtcgtgggggaggactggaagaccaagtccttcatctacaagaccacgaacagcaagggcatcgaggtgtcccgcaccgtcaactacaaggacctgtggcacctcctcagcgtgtccaccagcgacatctacctgtacgagtacgcgaagaacaagctgggcctcgaggacaagaacgccaaggccttcagcaagatcaagctgaagaaggacttcgggaacctgtccctgaacgccatcaacaagatcctcccctacatgcgggagggcctgctgtacagccacgccgtgttcatggcgaacatcgagtccatcgtcgacgaggtgatctggaacgacctcgggcagcgcaagtacatccaggacaagatcgccgccatcatcgccaacaacatcgtggacaacggcctgctggaggtcgtgaacgggctcatcaaggagtgcaaggtcgacggcgcctactacagcaaggaggcggccgacacctaccggaaggacctgtccaagaagctggtgagcttcttcaagttccaccacatcgacgacggcatcaagcaggagacgatcctcaacgagctgttccccgtgttcatcgagcagctgaaggcccacgagttcatcaaggtcaagcgcctcgacgagaaggtgctggagttcctgaagggggagaaccaggacggcgaggtgttctgcaacaacgccaagcagctcaagaagctgtaccacccgtccgacatcgaggtcttcaagaagcagatcgtgaaggacaaggacgggaccgagaccggccagctgatcctcggcagccccctgacctccagcatcaagaaccccatggcgatgcgggccctgcaccagctccgcaaggtgctgaacacgctgatcgtcgaggagcaggtcgactccagcacccggatccacatcgagatggcccgcgagctcaacgacgccaacaagcggaaggggatccaggactaccagaacgagaacaagaaggagcgcgagaagtaccgggacgagatcaagaagctgtacctggccgagtgcaacaaggagatcgagcccaccgtggacgacctcctgcgctaccagctgtggatcgagcaggaccggaaggagatctacgagaacggcaactccatcagcatctgcgacatcatcggggacaacccggcgtacgacatcgagcacaccgtgccccgctccatcagccaggacaactcccagatgaacaagacgctctgcagccagaagttcaaccgggacgtgaagaagcagaagatgcccttcgagctgggcaaccacctggagatcctcccccgcatcgcccactggaaggaggaggccgacaacctgagccgggagatcgagatgatcatccgctccaccaagaccgccgccaccaaggaggcgaaggacaagaagatccgccggcgccactacctgacgctccggcgcgactacctgcaggggaagtacgaccggttcatctggaccgagccgaaggtgggcttcaagaacagccagatccccgacaccggcatcatcacccgctacgcccaggcctacctgaagtcctacttcaaccgggtcgagagcgtgaagggcgggatggtggccgagttccgcaagatctgggggatccaggagtcctaccaggagaacggcaagaagtacttcaaggagaaggaccggagcaagcacacgcaccacaccatcgacgccatcaccatcgcgtgcatgaccaaggacaagtacgacgtcctcgcccacgcctggaccctggaggacaaggagcagatcacggaggcccgcaagatcgtggcggagtccaagccctggaagaccttcaaggaggacctgaagaagatcgaggaggggatcctcgtgagccactacacccccgacaacgtcaagaagcagtccaagaagatcgtgcgggtgcgcggccggaagcagtacgtcgccgagatcgagcgcgacgtgaacggcaaggccgtggccaagaaggacatcagcgggaaggtcatctacaagctggacaaggacggcaagaagctgccgcggctccagcagggggacaccatccgcggctccctgcaccaggacagcatctacggggccatcaagaaccccctgaagacggaggagatccggtacgtgatccgcaaggacctcgagtccatcaaggcgagcgacgtggacaacatcgtcgacgagatggtgaaggagaaggtgaaggaggccatcgcctccaaggtcctgatcctgagctccaacccccagcagaagaacaagatcgacggcaaggtgtggatgaacgaggagaagggcatccccatcaacaaggtgcggctctacgccaacagcgtcaagaacccgctggagatcaaggagcactccagcctgagcaagtcccgccacgagcacaagcagaaggtgtacgggcagaacgacgagaacttcgccatggcgatctacgagggcctcgacaagaaggggaagaccgagcgggccttcgagctgatcaactacatggacgccggctactactacaagctgaagaacaagaacgagcgcaagaaggacatcatcagcctcgtgcccgagaagcacatcgagaccgggttcaacctgctgcgctccaacaagatccccatcatcctcaagaagggcctgaacgtcatcctgtacaagaacgagaaggaggagatcgacttcaacaacccgaacagcatcatcaagcggctctacaagatctccggcctggacaaggacgggatcaagctgatgtactgcatcagcgccaagggctccaccgagaacatcgcctacatgaacgacgtgatcaacaagcagaagctgttcgagctcaagagcgagatggagaagctggggctgtgggacaaggtgttctccgacttcaagaacgacaacctgaagaagtccgacttcttcaagaagctgaacgacctcctgaacaagcactacttcgagaacaacgtctgcgacagcatcggcagcatcaagaaggtgaagatcaaggagtccggcctgacgacccccaagggcggggacgtgatcgacaacttcaaggacttcccctacatcaagttcaaggtcagcaacttcaacgcgctcatcgaggggatcgacttcaagatctcccccaccggcaagttcgtgcagatctga

SEQ ID NO: 2283 - RNA, 4587 nt, synthetic construct
  misc_feature 1..4587: note = Cas9 variant
  source 1..4587: mol_type = other RNA
atgaagaagatcctgggcctcgacctggggaccaacagcatcggctgggccctggtggagcaggacttcaagaacaagcaggggaacatcatgggcatggggtcccgcgtcatccccatgagccaggagatcctcggcgagttcgcccggggcaacaccaagtccgagacggcggagcgcacccggctgcgcagcgtgcggcgcctgcgggagcgccacctcctgcggcgcgagcggctgcaccgcgtgctccacatcctggggttcctgccgaagcactacgtcaaccagatcgacttccaggagcggctcggcaagttcttcgaggagtccgagcccaagctggcctacgacaccggggacttcctgttcaagcccagcttcctcgagatgctggaggagttcaagatccaccagccctccttcgtggagggcgacaagaaggtgccgtacgactggaccatctacttcctgcgcaagaaggccctcacggagcggatcgagaaggaggagctggcctgggtcatcctgagcttcaaccagaagcgcgggtactaccagctccggggcgaggacgaggaggagaagcccaacaagctggaggagttctactccctgaagatcgtggacatcaaggtggacgagagccccaacaagaagggcgacacctggtactccctcaccctggagaacgggtggatctaccgccggagctccaaggtccccctggacgactggctcggcaagacccgcgacttcatcgtgacgaccgacatcgacgaggaggggaacccgaagctggacaaggagggcaaccccaagcggagcttccgcgccccctccgaggacgactggggcctgcgcaagaagaagaccgagaaggagatcctcgacagctccaagaccgtggggcacttcatcttcgagaacctgctggcggaccccacgcagaagatcaagggccggctcgtccgcaccatcgagcggaagttctacaaggacgagctgaagcagatcctggtgagccagaaccgcttccacccggagctctccgacgccgacatgatggccgactgcgtgcgggagctgtacaagcacaaccacagccaccagaacttcctggccagcaaggacatcaagcacctcctggtcgacgacatcatcttctaccagcgccccctgcggtcccagaagtccaccatcgggaactgccccctcgagttcaagaccttcaagaaggacggcatcgagatcaaggtgccctacaaggtggcgcccaagagccacccgctgttccaggagttccgcctgctccagtgggtcagctccctgcggatcatccgcaagagcgacgactccgacgtgacgcgggagttcctggggacccaggacaagaccaagcagctcctggactacctgatgacccagagcgagatggactgcaacaagctgatgacgttcctcctgacccaggagggctacaagcgcaaggacctgaagtccgaggtgggcaagttccggtggaactacgtcttcgacagcgagaccggggagtccaagacctaccccggcaacagcacgcgcgccgagttcctcaagcggctggggaaggtggagggcttcgacttctccaagtacaccgaggagttcgaggagagcctgtggcacctcgtgtactccgtcaccgacaaggtggagttcgagaaggccctgcgcaagttcagccggaagaacgggatcgagatcaactccttcgtcgagaacctgaagaagttcccgccctacaagagcgagtacgcctcctacagcctcaaggccatcaagaagctgctggcgctcatgcgcttcggcgagaactggaaggaggacagcatcgactccatcagcaagcaccggatcgagaagatcctgaccggcgagtacgaccccgagatcaaggacaaggtgcgcgagatctcccgcgccttcgacgaggtggaggacttccaggggctgcccgtctggttcgccaactacgtggtgtacggccggcacagcgaggcctccgagctcatcaagtggacgagctccgacgagatggccgacttcatcaaggagttcaagcagcacagcctgcgcaaccccatcgtcgagcaggtcgtgctggagaccctccgggtggtgaaggacatctgggacaagtacgggcacggccagaaggacttcttcgacgagatccacgtggagctggggcgcgagctgaagaacccggcggagcagcgggcccgcctcaccacccagatctccgccaacgagaacacgaacctgcggatcaagagcctgctcgtcgagctgctgcacgaccccggcgtggagaacgtgcgcccctactcccccatgcagcaggagatcctcaagatctacgaggagggcgtcctcaagagctccttcgaggtgccggacgacatcctgaagatcagcaagaccgcccagccctccagctccgacctgaagcggtacaagctgtggctggagcagaagtaccgcagcccctacaccgggaagatcatcccgctcaacaagctgttcacccccgcctacgaggtggagcacgtcatcccccagagccggtacttcgacgactccttcagcaacaaggtgatctgcgaggcggccgtgaacaagctgaaggacaaccgcctcggcatggagttcatcaagtgcttccacgggcagcgggtctccctgggcttcggcgaggaggtggagatcttcagcgagtccgcctacaaggccttcatccaggacaacttccccaagaacccggccaagaagcgcaagctgctcatggacgagctgcccgagcagatggtggagcggcagatgaacgacacgcgctacatcagcaagttcgtcacctccatcctgagcaacatcgtgcggtccgaggagaacgacaccgggttcaacagcaagaacatcatccccggcaacgggaagatcaccaccgcgctcaagcaggactggggcctgaacgacgtgtggaacgagctgatcctcccccgcttcgagcggatgaaccagctgacggggaccaccgtcttcaccgcctggaacgagaaccaccagaagttcctgccgacggtgcccctcgagtacgccaagggcttccagaagaagcgcatcgaccaccggcaccacgccatggacgcgctggtgatcgcctgcgccacccgcgaccacgtcaactacctgaacaacgagcacgccctcggcaagaactacaaggggaaggaggagaagcagtcccgccggttcgacctgcgccagaagctgtgcctcaagaagaagaacggccacagccaggagcagtacgagtggatcttctccaagccctgggacagcttcacccaggacgccaagaagaacctggagcggatcatcgtgtccttcaagcagaacctgcgcgtgatcaacaagaccagcaacaagtacctctcctacaaggacgaggaggggaacctgcggctggacagccagggcaagcccgtcaaggcgctcacgcgccagatcaagggggacgcctgggccatccggaagtccatccacaaggacaccgtgagcggcctggtgaagctgcgccgggtcaagatggtgaacctcagcgtggccctggacaacccggagaacatcctgaacaagaagctcaagaagaagatcgccgagctggtcaagctgaactacgacaacaagctcctgctgaagtacttccgcgaccgggactacatgttcgacggccgcgaggtgtccaagctcgacgtgtactacttcgaggaggggctggcggccagccgggtctccctggacaccagcttctccgacaagaagatccagagcatcaccgacacgggcatccgcaagatcctcctggcccacctggccaactaccacgggcggctcgacgagaagggcaaggtgatcccgcccgagaccctggccttcacccccgaggggatcgaggagctgaacaagaacatcaagggcctcaacggcgggaagttccaccagcccatcttcaaggtgcgcacctacgagcccaagggcaacaagttccaggtcgggttcaagggcaacaagaactccaagtacgtggaggcggccaaggggacgaacctgttcttcgccatctacctgaacgacgagggcaagcggagctacgagaccatccccttcaacgtggtcatggagcgcctcaagcagggcgaggggcccgtgccgcagaccaacgagaagggcgggaagctgctgttccacctctcccccaacgagctggtgtacgtccccgagaccgacgagaactacacgaacgtggacttcaagaacctgagcaaggagcaggtcgagaagatctacaagatggtgtccagcaccggctccgagtgccacttcgtgcgggccgacatcagctccctcatcaagggctacgacgcgaagaccaaggtcggggagctgggcagcctgaacaagcaggaggtgaccaacaacgggatgacgcgcatcaaggagaagtgctggaagatcaagatcgaccgcctcggctccatctga

SEQ ID NO: 2284 - RNA, 4587 nt, synthetic construct
  misc_feature 1..4587: note = Cas9 variant
  source 1..4587: mol_type = other RNA
atgaagaagatcctgggcatcgacctcgggaccaacagcatcggctgggccgtggtcaactccttcgacgagaaccagaacgaggagagcctgaagcacatcgagtgcgtggggtcccgcatcatccccatggacgccgcgatcctgggcgacttcgacaaggggaacagcatctcccagaccgccaagcggacggagttccgcagcgtgcggcacctccgcgagcggcacctcctgcgccgggcccgcctccacaagatcctgtccctgctcggcttcctgccggaccactacgtccaggacctggacagccacggcaacttccccgtgaacgtggagcccaagatcgcctggcggaaggactccaacggggccttcgagttcatcttcaacgacagcttcgacgagatgctccaggacttcgcgacctaccagcccgagctgatcgcctgcaacaagaaggtcccgtacgactggaccatctactacctgcgcaagaaggccctcaccaagaagctgtccaaggaggagctgagctggatcctcctgaacttcaaccagaagcggggctactaccagctgcgcggggaggaggacgacgagtccgtcaagagcgccaagacgcggcagtacttcgaccgccagaagatcaagtccatcgtggacaccaaccagacctacaagggccagaaggtgctcatcgtggagctggaggacgggatcaagggcaagatcttcaagaaggagatccccaactgggtgggccaggagaagtccatcatcgtcaccatcgacatcgacaaggacgggtgcgacaagtacgaggagagcggcgagctgagctgccggttcaagatcccctccgacgcggagtgggagagcgagtggaagctcatcaagatgaagacgcagaaggacctggacgccagcgggaagaccgtgggcgcctacatctacgacgccatcctgcagaacccctcccagaagatccgcggcaagctcgtgcggaccatcgagcgcaagtactacaaggaggagctgaagcagatcctgaagaagcaggtcgagttccacccggagctccgggacaaggacctgttcctggactgcctcaacgagctgtaccccaacaacgacgcccaccgcaacgcgtgcgccgaccgggacttcatctacctgttcatggacgacatcctcttctaccagcgccccctcaagagcaagaagtccctgatcgccgactgcccctacgagaagcacatgtaccgcgacaaggagaccggggagctgaagtacagctccgtgaagtgcatcgccaagagccacccgctgttccaggagttccggctgtggcacttcatctccaacatccgcatctaccagaaggagcgggtggtcgacgtggacgccgaccagagcgcgctctccagcgcccgctccgccctcaagagcaagctggaggccgacgtggacgtcacgaacgagttcctgacctgcgaggccgactacgtgtccctgttcgagtggctgaacaacaagaagtccgtgagccagaaggacttcctgaagtaccccgcgttcggcatcaagaagtccggggacaactaccggtggaactacgtcgaggacaagagctacccctgcaacgagacccgcgccctgatcctgagccacctggagaaggccaacatccggggcgacatcttcacccgcgagcaggaggaggccctctggcacatcctgtactccgtggaggaccggtacgagatcgtcaaggccctgcagagcttcgcggccaagtaccgcttcaacgacgacttcgtgacggtgttcagcaagttcccgcccttcaagaaggagtacgggtcctacagcgccaaggccatcaagaagctcctgcccctgatgcggatgggcaagtactggtccgaggcggccatcgacatcaagacccgcgagcggatcgagaagatcatcaccggcgagtgcgacgacagcatccgcgagcgggtccgcctcaaggccatccggctgcacgacatcggggacttccgcgccctgcccgtgtggctcgcctgctacgtggtctacgaccggcactccgagagcggcgacatcaccaagtggaagacgccccaggagatggactggtacatccagaacttcaagcagcactccctgcgcaacccgatcgtggagcaggtcatcaccgagaccctgcgcgtggtgcgggacatctggaagcaggtcgggcgcatcgacgagatccacgtggagctcggccgggagatgaagaaccccgcggacaagcgcgccaagatgaccgcccggatgatcgagaacgagaacacgaacctgcgcatcaaggccatgctgaccgagttcctcaaccccgagttcgagatcgagaacgtgcggccctacagcgcctcccagcaggacatcctgcgcatctacgagaacggggtgctgaacagcgtctccgagatcccggaggagatcaccggcatcctcaagaagttcaacgagcgggagcagcgcaagcggcccagcacctccgaggtgctgcgctacaagctgtggctcgagcagaagtaccggagcccctacacgggcaagatgatccccctggggaagctgttcaccccggcgtacgagatcgagcacatcatcccccagtcccgctacttcgacgacagcttcaacaacaaggtgatctgcgaggccgaggtcaacaagctcaagggcaacctgctggggtacgagttcatcaagaagcaccacggccggcgcgtggacctcgggctgggcgagatcgtggacatcttctccgtcgacgagtacgagaccttcgtgaaggactactacagcgccaaccagcagaagatgaagaagctgctcatggacgagatccccgagcagttcatcgagcggcagctgaacgacagccgctacatctccaaggtggtcaagagcctgctctccaacatcgtgcgggagcaggacgagcaggagagcatctccaagaacctgatcgtgtgcaccggcggggtcacggaccgcctgaagaaggactggggcatcaacgacgtgtggaacaagctcatcctgccgcggttccagcgcctgaacaacatcaccgagaccaccgagttcacggccaagaacatgcaggggcacgagatccccgtggtccccttcgagtaccagcgcggcttcaacaagaagcggatcgaccaccgccaccacgccatggacgcgatcgtgatcgcctgcgccggccggaacatcgtgaactacctcaacaacgagagcgcccgcaagaaggcgcagatctcccggtacgacctgcagcgcctgctctgcgacaaggtcaagaccgacgacaacgggaactacaagtggatcctgaagaagccctggagcaccctgacccaggacgtgtacgccgccctcgacaacgtgatcgtctccttcaagcagaacctgcgggtgatcaacaagaccaacaaccactacgtgcactacgaggccggcaagaagatcatcgccaagcaggagaaggcgagctgggccatccgcaagccgatgcacaaggacacggtcttcggggaggtgaacctgcggaaggtgaagaccgtctccctcaacgaggccatcaagagcccccactgcatcgtgcagaaggacttcaagaagaagctgctgtccctcctgaagcagaacttcgacgccaaggaggtgaaggcctacttcgaggagcacaaggacgtctggagcgacatcaacctgtccaagatcgaggtgtactacttcaccaaggacaccaaggagcgcttcttcgcgacgcggaagcccctcgacagctccttcgaccgcaagaagatcgagagcgtgaccgacaccggcatccagaagatcctgctgcggcacctcgagcagaagaacggggactccgacctggccttcagccccgacggcatcgaggagatgaaccagaacatcgtccagctgaacggcgggcgcaagcaccagccgatcgtgaaggtgcgggtctacgagaaggccgacaagttcgccatcggccagcaggggaacaaggccagcaagtacgtggaggcggccaagggcaccaacctcttcttcgccgtctacgaggaggaggtgcgcgacaagaagacgaacgccgtgatgttcaagcggaactacgcgtccatccccctgaacgtcgccatcgaccgccagaagaaggggctgagcaccgcccccgaggacgagaacggcaacgcccccatcttcgtgctctccccgaacgacctggtgtacctgcccaccgccgaggacatcatcaacgcgcggatcagcttccccatcaacaagaaccgcatctacaagatggtctcctgcaccggctaccagtgcttcttcatcaagcaccacgtggccaacgtgatcgtcgacaagaaggagttcagcgccctcaacaagatggagaaggccgagacgaacgagatgatcaaggacatctgcgtgcccatcaagctggaccgcctggggaacatcgtgaagatcggcgtctacaagtga

SEQ ID NO: 2285 - RNA, 4587 nt, synthetic construct
  misc_feature 1..4587: note = Cas9 variant
  source 1..4587: mol_type = other RNA
atgaagaagatcctgggcctcgacctggggaccaacagcatcggctgggccgtggtcaactccttcgacgagaaccagaacgaggagagcctgaagcacatcgagtgcgtggggtcccgcatcatccccatggacgccgcgatcctcggcgacttcgacaaggggaacagcatctcccagaccgccaagcggacggagttccgcagcgtgcggcacctccgcgagcggcacctcctgcgccgggcccgcctgcacaagatcctgtccctcctgggcttcctgccggaccactacgtccaggacctcgacagccacggcaacttccccgtgaacgtggagcccaagatcgcctggcggaaggactccaacggggccttcgagttcatcttcaacgacagcttcgacgagatgctgcaggacttcgcgacctaccagcccgagctgatcgcctgcaacaagaaggtcccgtacgactggaccatctactacctccgcaagaaggccctgaccaagaagctgtccaaggaggagctcagctggatcctgctgaacttcaaccagaagcggggctactaccagctccgcggggaggaggacgacgagtccgtcaagagcgccaagacgcggcagtacttcgaccgccagaagatcaagtccatcgtggacaccaaccagacctacaagggccagaaggtgctgatcgtggagctggaggacgggatcaagggcaagatcttcaagaaggagatccccaactgggtgggccaggagaagtccatcatcgtcaccatcgacatcgacaaggacgggtgcgacaagtacgaggagtccggcgagctcagctgccggttcaagatcccctccgacgcggagtgggagagcgagtggaagctgatcaagatgaagacgcagaaggacctggacgccagcgggaagaccgtgggcgcctacatctacgacgccatcctccagaacccctcccagaagatccgcggcaagctggtgcggaccatcgagcgcaagtactacaaggaggagctgaagcagatcctcaagaagcaggtcgagttccacccggagctgcgggacaaggacctgttcctcgactgcctgaacgagctgtaccccaacaacgacgcccaccgcaacgcgtgcgccgaccgggacttcatctacctcttcatggacgacatcctgttctaccagcgccccctcaagagcaagaagtccctgatcgccgactgcccctacgagaagcacatgtaccgcgacaaggagaccggggagctgaagtacagctccgtgaagtgcatcgccaagagccacccgctgttccaggagttccggctctggcacttcatctccaacatccgcatctaccagaaggagcgggtggtcgacgtggacgcctgccagcccgacctgagctccgcgcgcagcgccctgaagtccaagctcgaggccgacgtggacgtcacgaacgagttcctgacctgcgaggccgactacgtgagcctgttcgagtggctcaacaacaagaagtccgtgagccagaaggacttcctgaagtaccccgccttcggcatcaagaagtccggggacaactaccggtggaactacgtcgaggacaagagctacccctgcaacgagacccgcgcgctgatcctgtcccacctcgagaaggccaacatccggggcgacatcttcacccgcgagcaggaggaggccctgtggcacatcctgtacagcgtggaggaccggtacgagatcgtcaaggccctccagtccttcgccgcgaagtaccgcttcaacgacgacttcgtgacggtgttcagcaagttcccgcccttcaagaaggagtacgggagctactccgccaaggccatcaagaagctgctgcccctcatgcggatgggcaagtactggagcgaggccgcgatcgacatcaagacccgcgagcggatcgagaagatcatcaccggcgagtgcgacgactccatccgcgagcgggtccgcctgaaggccatccggctgcacgacatcggggacttccgcgccctccccgtgtggctggcctgctacgtggtctacgaccggcacagcgagtccggcgacatcaccaagtggaagacgccgcaggagatggactggtacatccagaacttcaagcagcacagcctgcgcaaccccatcgtggagcaggtcatcaccgagaccctccgcgtggtgcgggacatctggaagcaggtcgggcgcatcgacgagatccacgtggagctgggccgggagatgaagaaccccgccgacaagcgcgcgaagatgaccgcccggatgatcgagaacgagaacacgaacctgcgcatcaaggccatgctcaccgagttcctgaaccccgagttcaagatcgagaacgtgcggccgtactccgccagccagcaggacatcctgcgcatctacgagaacggggtgctcaactccgtcagcgagatccccgaggagatcaccggcatcctgaagaagttcaacgagcgggagcagcgcaagcggccctccaccagcgaggtgctgcgctacaagctctggctggagcagaagtaccggtccccctacacgggcaagatgatcccgctggggaagctgttcacccccgcctacgagatcgagcacatcatcccccagagccgctacttcgacgactccttcaacaacaaggtgatctgcgaggcggaggtcaacaagctgaagggcaacctgctcgggtacgagttcatcaagaagcaccacggccggcgcgtggacctggggctgggcgagatcgtggacatcttcagcgtcgacgagtacgagaccttcgtgaaggactactactccgccaaccagcagaagatgaagaagctcctgatggacgagatcccggagcagttcatcgagcggcagctgaacgacagccgctacatcagcaaggtggtcaagtccctcctgagcaacatcgtgcgggagcaggacgagcaggagtccatcagcaagaacctgatcgtgtgcaccggcggggtcacggaccgcctcaagaaggactggggcatcaacgacgtgtggaacaagctgatcctgccccggttccagcgcctcaacaacatcaccgagaccaccgagttcacggccaagaacatgcaggggcacgagatccccgtggtccccttcgagtaccagcgcggcttcaacaagaagcggatcgaccaccgccaccacgccatggacgccatcgtgatcgcgtgcgccggccggaacatcgtgaactacctgaacaacgagtccgcccgcaagaaggcccagatcagccggtacgacctgcagcgcctcctgtgcgacaaggtcaagaccgacgacaacgggaactacaagtggatcctgaagaagccgtggtccaccctcacccaggacgtgtacgcggccctggacaacgtgatcgtcagcttcaagcagaacctgcgggtgatcaacaagaccaacaaccactacgtgcactacgaggccggcaagaagatcatcgccaagcaggagaaggcctcctgggcgatccgcaagcccatgcacaaggacacggtcttcggggaggtgaacctccggaaggtgaagaccgtcagcctgaacgaggccatcaagagcccccactgcatcgtgcagaaggacttcaagaagaagctgctcagcctgctgaagcagaacttcgacgccaaggaggtgaaggcctacttcgaggagcacaaggacgtctggtccgacatcaacctcagcaagatcgaggtgtactacttcaccaaggacaccaaggagcgcttcttcgccacgcggaagcccctggactccagcttcgaccgcaagaagatcgagtccgtgaccgacaccggcatccagaagatcctgctccggcacctggagcagaagaacggggacagcgacctggcgttctccccggacggcatcgaggagatgaaccagaacatcgtccagctcaacggcgggcgcaagcaccagcccatcgtgaaggtgcgggtctacgagaaggccgacaagttcgccatcggccagcaggggaacaaggccagcaagtacgtggaggccgcgaagggcaccaacctgttcttcgccgtctacgaggaggaggtgcgcgacaagaagacgaacgccgtgatgttcaagcggaactacgccagcatccccctgaacgtcgcgatcgaccgccagaagaaggggctctccaccgcccccgaggacgagaacggcaacgccccgatcttcgtgctgagccccaacgacctggtgtacctccccaccgccgaggacatcatcaacgcccggatctccttccccatcaacaagaaccgcatctacaagatggtcagctgcaccggctaccagtgcttcttcatcaagcaccacgtggcgaacgtgatcgtcgacaagaaggagttctccgccctgaacaagatggagaaggccgagacgaacgagatgatcaaggacatctgcgtgccgatcaagctggaccgcctcgggaacatcgtgaagatcggcgtctacaagtga

SEQ ID NO: 2286 - RNA, 4590 nt, synthetic construct
  misc_feature 1..4590: note = Cas9 variant
  source 1..4590: mol_type = other RNA
atgaagaagatcctgggcctcgacctggggaccaacagcatcggctgggccgtggtcaactccttcgacgagaaccagaacgaggagagcctgaagcacatcgagtgcctcgggtcccgcatcatccccatggacgccgcgatcctgggcgacttcgacaaggggaacagcatctcccagaccgccaagcggacggagttccgcggcgtgcggcacctccgcgagcggcacctcctgcgccgggcccgcctgcacaagatcctccggctgctgggcttcctcccggaccactacgtgcaggacctggacgggcacggcaacttcctggtcaacgtggagcccaagatcgcctggcgcaaggacagcaacgggaccttcgagttcatcttcaacgactccttcgacgagatgctccaggacttcgccacctaccagcccgagctgatcgcgtgcaaccggaaggtgccctacgactggaccatctactacctgcgcaagaaggccctcacgaagaagctgagcaaggaggagctgtcctggatcctcctgaacttcaaccagaagcggggctactaccagctgcgcggggaggaggacgacgagagcgtcaagaccgccaagacccggcagtacttcgaccgccagaagatcaagtccatcgtggacaccaaccagacgtacaagggccagaaggtgctcatcgtcgagctggaggacggcgtgaaggggaagatcttcaagaaggagatcccgaactgggtgggccaggagaagtccatcatcgtcaccgtggacatcgacaaggacgggtgcgacaagtacgaggagagcggcgagctgagctgccggttcaagatcccctccgacgccgagtgggagagcgagtggaagctcatcaagatgaagacccagaaggacctggacgcgtccggcaagaccgtgggggcctacatctacgacgccatcctgcagaaccccagccagaagatccgcggcaagctcgtccggacgatcgagcgcaagtactacaaggaggagctgaagcagatcctgaagaagcaggtcgagttccaccccgagctccgggacaaggacctgttcctggactgcctcaacgagctgtacccgaacaacgacgcccaccgcaacgcctgcgcggaccgcgacttcatctacctgttcatggacgacatcctcttctaccagcggcccctgaagtccaagaagtccctgatcgccgactgcccctacgagaagcacatgtaccgcgacaaggagaccggggagctcaagtacagcagcgtgaagtgcatcgccaagagccaccccctgttccaggagttccggctgtggcacttcatctccaacatccgcatctaccagaaggagcgggtgatcgacgtggacgcctgccagccggacctcagctccgcccgcagcgcgctgaagtccaagctggaggccgacgtggacgtcaccaacgagttcctgacctgcgaggccgactacgtgagcctgttcgagtggctgaacaacaagaagtccgtgagccagaaggacttcctgaagtaccccgccttcggcatcaagaagtccggggacaactaccggtggaactacgtcgaggacaagagctacccctgcaacgagacgcgcgccctcatcctgtcccacctggagaaggcgaacatccggggcgacatcttcacccgcgagcaggaggaggccctctggcacatcctgtacagcgtggaggaccggtacgagatcgtcaaggccctgcagtccttcgccgccaagtaccgcttcaacgacgacttcgtgaccgtgttcagcaagttcccgcccttcaagaaggagtacggctcctacagcgcgaaggccatcaagaagctcctgcccctgatgcggatggggaagtactggtccgagagcgccatcgacatcaagacccgcgagcggatcgagaagatcatcacgggcgagtgcgacgacagcatccgcgagcgggtccgcctcaaggccatccggctgcacgacatcgagcacttccgcgcgctgcccgtgtggctcgcctgctacgtggtctacgaccgccactccgagagcggggacatcatgaagtggaagacgccccaggagatggactcctacatccagaacttcaagcagcacagcctgcggaacccgatcgtggagcaggtcatcaccgagaccctgcgcgtggtgcgggacatctggaagcaggtcggccgcatcgacgagatccacgtggagctcgggcgggagatgaagaaccccgccgacaagcgcaaggagatgaccaagcggatcatcgagaacgagaacaccaacctgcgcatcaaggccatgctgaccgagttcctcaaccccgagttcgagatcgagaacgtgcggccctactccgccagccagcaggacatcctgcgcatctacgagaacggcgtgctgaactccgtcagcgagatcccggaggagatcaccggcatcctcaagaagttcaacgagcgggagcagcgcaagcggccctccacgagcgaggtgctgcgctacaagctgtggctcgagcagaagtactgctccccctacaccgggaagatgatccccctgggcaagctgttcaccccggcgtacgagatcgagcacgtgatcccccagagccggtacttcgacgactccttcaacaacaaggtcatctgcgaggccgaggtgaacaagctcaaggggaacctgctgggctacgagttcatcaagaagcaccacgggcagcgcgtggacctcggcctgggcgagatcgtcgacatcttcagcgtggacgagtacgagaccttcgtgaaggactactactccgggaaccagcagaagatgaagaagctgctcatggacgagatccccgagcagttcatcgagcggcagctgaacgacagccgctacatctccaaggtcgtcaagagcctgctcagcaacatcgtgcgggagcaggacgagcaggagtccatcagcaagaacgtgatcgtgtgcacgggcggggtgaccgaccgcctgaagaaggactggggcatcaacgacgtctggaacaagctgatcctcccgcggttccagcgcctgaacaacatcaccgagaccacggagttcaccgccaagaacatggagggccacgagatccccgtggtgcccttcgagtaccagcgcgggttcaacaagaagcggatcgaccaccgccaccacgccatggacgccatcgtcatcgcgtgcgcctcccggaacatcgtgaactacctgaacaacgagagcgcccgcaagaaggcccggatctcccgctacgacctccagaagctgctgtgcgacaaggtgcggaccgacgacaacggcaactacaagtggatcctcaagaagccctgggggaccctgacccaggacgtctacgccgcgctggacaacgtgatcgtgagcttcaagcagaacctccgcgtcatcaacaagacgaagaactactacgtgcactacgaggccggcaagaagaccatcgccaagcaggagaaggggtccagctgggccatccggaagccgatgcacaaggacaccgtgttcggcgaggtcaacctgcgcaaggtgaagaccgtgtccctgaacgaggcgatcaagaacccccagtgcatcgtcgagaaggacttcaagaagaagctcctgagcctgctcaagcagaacttcgacgccaagaaggtgaaggcctacttcgaggagcacaaggacgtgtggtccgacatcaacctgagcaagatcgaggtctactacttcacgaaggacaccaaggagcggttcttcgccacccgcaagcccctggactccagcttcgacaagaaggagatcgagtccgtgaccgacacgggcatccagaagatcctcctgcggcacctggagcagaagaacggggaccccgacctcgccttcagcccggacggcatcgaggagatgaaccacaacatcgtgcagctgaacgggggccgcaagcaccagcccatcgtcaaggtgcgggtctacgagaaggcggacaagttcgccatcgggcagcagggcaacaagtccagcaagtacgtggaggccgccaagggcaccaacctgttcttcgccgtgtacgaggaggaggtccgcgacaagaagaccaacgcggtgatgctcaagcggcactacgcctccatccccctgaacgtggccatcgaccgccagaagaaggggctgagcaccgcccccgaggacgagaacggcaacgtcccgatcttcgtgctcagccccaacgacctggtgtacctgcccacggccgaggacatcgcgaacgcctccatcagcttccccatcaacaagaaccggatctacaagatggtctcctgcaccgggaaccgctgcttcttcatcaagcaccacgtggccaacgtgatcgtcgacaagagcgagttctccgtgctcaacaagatcgagaaggccgagaccgacgagatgatcaaggagatctgcgtgccgatcaagatcgaccgcctgggcaacatcgtcaagatcggggtgtacaagtga

SEQ ID NO: 2287 - RNA, 4608 nt, synthetic construct
  misc_feature 1..4608: note = Cas9 variant
  source 1..4608: mol_type = other RNA
atgaacaccatcctgggcctcgacctggggaccaacagcatcggctgggccctgatcaaggtgctcaacgacaagacgcgcctgcccctggagatcatcgacctcggggtcgtggtgatcccgaccgaccagcggaccctggacaagttctccaagggcgagagcatctccaagaccgccgagcgcacgaagcagaagggggtccggaagctgtacgagcgcaagaagctccggcgcgagcggctgcaccgcgtgctgaacatcctcggcttcctgcccgagcactacagcaagaagatcgacttcaagaagcacctgggccagttcttcgggaactcccagcccaagatcagctacgtggagaacgaccacggcaagcacgagttcatcttcatggactcctaccgggagatgctcaaggagttcagcaagcacaacatcaagaacgtcccctacgactggaccatctactacctgcgcaagaaggcgctgtcccagaagatcagcaaggaggagctcgcctgggtgatcctgaacttcaacaagaagcgggggtactaccagttccgcgacgacaacgccgacgagaacaaggagaacaagatcgagaagtactacgccctgaaggtgaccaacgtcaagaaggaggacgcccagaactacaccatcacgctcgagaacggctggatctacaagaacaagtccaagatcagcctgctggactgggtggggtccaccaaggagttcatcagcaccgagaagttcgacaacaagggcaacatcatcaagaagaagaacggcgaggacgaccggaccctcaagctggtggactccgagaaggactggatcgcgatcaagaagtccacggaggaccgcatcgagaactacgggaagaccgtcggcacctacctgtacgagcacctcctgaaggacccgaaccagaagctgaacggggagctcatcaacatcatcgaccggaagttctacaagaacgagctgaagcagatcctggagaagcagaaggagttccaccccgagctcctgaacgaggacctgttccagaagtccatcatcgagctctaccccaagaacagcacccgccagaaggagctgaagaacaaggacctgtgctacctcctgatcgacgacgtgatctactaccagcgggacctgaagaagaagaacagcacgatcaacaagtgcagcttcgagagccgcgagtactacctcaacggcgagaagcagatccagaagatcaactgcatcgccaagtccaagcccctgtaccaggagttccggaccctgcagttcatcaagaacctcaaggtgtacgagatcatcgacggcctggagaaggacatcaccagcaagctgctcccggacttcgagaccaaggagcacttcttcgagtggctgaacgacaaggagaagatcgaccagctgcagctgctctcctacaagtgcttcgacctgcacgacaacgtcaagaacgacctgatcgccaaggggatcaagcgccccacggagaaggccatccggaccgagctcctggagaagtaccgctggaactacagcaaggacaacgaccgcaacttcctgctcaacgagacccggttcaagatcctgaagtacctgaagaaggtggacaagaagctcaccctgacgaacgagcagatcgagtccctgtggctcctgctgtacagcgcgaaggacgagcgcgagctcaagaacggcctgcagaagttctccgagaagaacaagctgcccaagaagttcagcgacatcttcatctccttcccgcccttcaagaaggagtacggggcctacagcgagaaggccctcaagaagctgctgtccctcgtgcggttcggcaagtactggagcttcaacaagatcgacaacaacatccagaacaagatcatgaacatcctgaacggggaggtcgacgactccatcagcgaccgcgtgcgggagaagaccatcctgctccaggacaagaacgacttccaggacctgcccctgtggctcgcctcctacgtggcctacaaccgcttcagcgaggtctccgagatcaagtactgggacagccccgacaagatcgagttcctgaagcagcactccatcggcaaccccatcgtggagaagatcatcaacgagaccctgaagctcatcaaggacatctgggtgatccacggcaagagctgcaagaacttcttcagcgagatccacatcgagctgtcccgggagatcaagagctccagcaagaagcgcgcgcagatcaccaacaacaacacgaagaaccagaagctgaacaacctcatcaagtccctgctgatcgagatggccagcgacaccaagtacgagaacgtcaccccgtactcccccagccagcaggagatcctcaagatctacgacgaggggatctactccaaggaggagaacagcgagaagatcaaggagatcaacaagatccggaacaacaacaagatctccaagagcgacatcaccaagtacaagctgtggctggagcagggctacatctccccctacacggggaagatcatccccctcaccaagctgttcaccgccaagtaccagaaggagcacatcatcccgcagaccaagttcttcgacgacagcttcaacaacaaggtgatctgcgaggccgaggtcaacaagctgaaggacaactccctcgccatgaacttcatcaaggcgaagggcgggaaggccgtgaagctgagcgacggcgagacggtgaccatcctgaaccaggaggagtacaagcagctcgtccgcacctccttcaagaagaacagcatcaagctgcggaacctgctcctggaggagatccccgacaccttcaccaagcgccagctgaacgacacgaagtacatcagcaagctcgtgctgtccctgctcagcaacatcgtgcgggagaagggcgagctggagtccaccgccaagcgcatcgtcagcaccaacgggcagatcacctccatcctgcggaacgactggggcctcaacaacatctggaacaagctgatcacgccccgcttcgagcggctgaacaacatcaacaagaacaagatctacgggaactgggagaacaagaagggcaagaacgtgttccagatcaactacctcaacgacaacctgagcaccctgaacaccaagcgcatcgaccaccggcaccacgccctcgacgccctgatcgtggcgtgcaccacgcgcaaccacatcaacttcctgaacaaccagtacgccaagtcccgcaaccagcggcacgacctccgcgccaagctgaagcggcgcgagaccatcaccaccgaggggagcaagaagcaggtcttcaaggacttcatcaagccctgggagtccttcacgcaggacgccctgaagaagctcgagaccaccatcgtgaacttcaaggtgaacaagcggatcatcaacaagaccatcaactggtacaagaagtgggagaagcagaaggacggcacgtacaagaagatccagaagaagcagaccaagggcgacgcctgggcgatccgcaagccgctgcacatcgacaccatctacgggatcgtctgcaagaagctgcccctcaagagcgccctggagaactacaagaacatcatcgacgagaacctgaagcacaagatcaaggagctcaaggaggtgaacaagttcgacaacaaccagatcatcaacttcttcaaggagtgcaacttcatcttcgaggacaacaacatccagaaggtggaggtctacgacttcaaggacaaccgggacaagaccatcctgtccagctcccgccagctgatcgacgagagcttcacgcccaagaagatcggcaaggtgctcgaccccaccatccggaacatcctgctgaagcacctcaactccaccaagtacaacaacaagttcgacagcgacgggaacccgatcaagcccgagaagctggccttctcccccgagggcctgaaggacctcaacaagaacatcaagcacctgaacaacaacaaggagcaccagccgatcaagcgcgtgaagctgttcgagaccctcggcaacaagatcaaggtcgggtacacgcagcagaagaacaagaagttcgccgagaccgcgaccggcaccaacctgttcctggggatctacagcgacaacaacaagcgggacttcaagacgatccccctcatcctggccatccagcgcgagaaggagggcctgaacccctgccccgacaccgacgagaaggggaaccagctcctgttctccctgagcccgaacgagctggtgttcgtgcccaacaacgaggagcggaagaaccccaacctcgtcgacttcgagaacctgagcaaggaccagatcgaccgcatctacaagttcgtgtcctgcaccggcagcgaggcctacttcgtgccctcccggaccgccaagccgatcatcgagaacgagaacggcacgaacaacaagagccagcgcatcatcgagttcaacgagaagacctccatcaagaacgagaagaacgagcccgtcctgatcaagaccatctgctggaagatcgaggtgaaccggctcgggaagatcatcaaggtgatcaagtga

SEQ ID NO: 2288 - RNA, 4608 nt, synthetic construct
  misc_feature 1..4608: note = Cas9 variant
  source 1..4608: mol_type = other RNA
atgaccaagatcctgggcctcgacctggggaccaacagcatcggctgggccatccgcgacacggagaacgaggggatcaaccagatcctggacaagggcgcccggatcttctccgagggggtcaagagcgagaacggcaaggagatctcccgcgcggccgagcggaccgcctaccgcagcgcccggaagatcaagtaccgccggaagctccgcaagtacgagaccctgaaggtgctgtccatcaacggcatgtgccccctcagcgtggaggaggtggagcagtggaagaagtccgggttcaaggagtacccgctgaaccccgagttcctggactggctccggaccaacgaggacaagaacatcaacccctacctgttccgcgacaaggccagcaagcagaaggtcacgctgttcgagctcggccgggcgctgtaccacatcgcccagcgccgggggttcctgtccaaccgcctcgaccagagcgccgagggcgtgttcgaggagcacaacccccagatccagaacctgatcgaggacctggactccagcaacaccatcctcaacgagctgaaggagtactacatcaacctggggatcatcgacgagaccgagaagtccggcttcaagaaggacctcgacgagggcgagaagaagctcaagagcctgtacaactccctggtggccatcaccaagaagaacgcgaacgacatcgagacgtgcaagcaggagctgatcgcccggctgaacaagaaggaggacctcgggaaggtcaagggcaagatcaaggacatcagccaggccatgctggaccgcaacttcaagaccctggggcagtacttcttctccctctacaacaaggagcggatccgcaaccagtacaccagccgggaggagcactacctggaggagttcatcatcatctgccagacccagggcatcgagggcatcaacacgaacgagaagctgccggagaagaagttcaccgggctcgccaaggacctgtaccgcgccatcttcttccagcggcccctgaagtcccagaagggcctcatcgggaagtgcagcttcgagaagaacaagagccgctgcgcggtgtcccaccccgactacgaggagttccgcatgtggagctacctgaacaccatcaagatcggcacccagtccgagaagacgctgcggttcctcaccctggaggagaagctgaagctcgtgcccaagttctaccgcaagagcgacttcaacttcgaggtcctggccaaggagctggtggagaagggggcctccttcggctactacaagagctccaagaagaacgagttcttctactggttcaactacaagccgaccgacagcgtgtccgcctgcgtcgtgagcgcctccctcgagaacgcgatcggcaaggactggaagatcaagaccttcgagtaccagacgcggaacaccgagaagaacgaggtgaccaagagcgtcgactacaaggacctgtggcacctcctgtccgtggccaccagcgacacgtacctgtacgacttcgccatcgagaagctgaagctggagcccaagaacgccaaggccttctccaagaccaagctcaagaaggacttcgcgagcctgtccctggccgccatcgccaagatcctcccctacctgaagcaggggctgctctacagccacgccgtgttcatggcgaacatcgagaacatcgtcgacgccgacatctggaaggacgaggagcagcagaagttcatccagtccaagatcgtggagctggtggacaactacatcgtcgagaagtccaagctggagctcatcaacggcctgctgaagatctacaacaccgaggacaaggaggggcgcaaggtgtactacagcaaggaggccgagtccctcttcgaggccgacctgcggaagaagctggtgcccttctacaaggcgaacatcatcatcgaggagcacgagcaggagatcatcttccaggacctcttcccgatcctgatggaccagctgaagaagcaggagttcatcaagatcggccgcctcgacaagcagatcgaggccttcctggagggggagaacgaggagggccagatcttctgcaaccacaccgacaagctgaagaagctctaccaccccagcgacatcgaggtcttcaagaagaagacgatcaaggacgagtggggcaacgagaaggtggtcctggggagccccctgaccaccagcatcaagaaccccatggccatgcgggccctccaccagctgcgcaaggtgctgaacaccctcatcgccaacgaccagatcgacgaggacacgcggatccacatcgagatggcgcgcgagctgaacgacgccaacaagcggaagggcatccaggacttccagaacgagaacaagaagttccgcgaggaggccatcaaggagatcaagaagctgtacctcgaggagtgccacaaggacgtgaacccgaccgaggacgacatcctgcggtaccagctgtggctcgagcaggggaagtgcgagatctacgaggagggcaacaacatctccatctgcgacatcatcgggagcaacccctcctacgacatcgagcacaccatcccccgcagcatctcccaggacaacagccagatgaacaagaccctgtgctccctgaagttcaaccggagcatcaagaagcagaagatgcccgtcgagctctccaactacaacgacatcctgccgcgcatcgcccactggaagaaggaggccgaggagctgacgcggcagatcgagaccatcagccgctccatcaagagcgcggccaccaaggtggccaaggacaagaacatccggaagcgccactacctcaccctgaagcgcgactacatcctgggcaagtacgagcggttcacctgggaggagcccaaggtgggcttcaagaactcccagatccccgacacggggatcatcaccaagtacgcccaggcctacctcaagagctacttcaagcgcgtcgagagcgtgaagggcggggcggtggccgagttccggaagctgtggggcatccaggagtccttcatcgacgagaactggtggaagcactacaaggacaaggaccgcgacaagcacacccaccacaccatcgacgccatcacgatcgcctgcatgcccaaggacaagtacgacctgctcgcgcacgcctggcggctggaggacgagcaggacaagaaggccgccaaggtcctgatcgagcaggccaagccgtggaagaccttcaaggaggacatcgagaagatcgagaccgagatcctcgtgagccacttcacccccgacaacgtgaagaagcagtccaagagcatcatcaagaaccgcggcaagaaggtctacgtgctgaagaacgagctgcccgtgaacttcaagaacaagatcgaggggaaggactacttcaagctcaagttcgactccaagatcctgtacaagatccccaagaagaaggagaagcagacggacaccttctacgaggagctgccgaagaactacctcaacggcgtcgaggggaaggactacttcaagatcaacaccaccggcaagacgttctacaagatccccatcttcaaccagggggacaccatccggggcagcctgcaccaggagaccacctacggcgcgatcaagctgcccgacatcgacatcgagacgaagaagccgctccacaccgacaagggcgggttcatcctgaagaaggacatcaaggggaacgagatcgtgttcttcgtggtccgcaaggagatctccaagatcagcgagaacgacgtgcagaacatcgtggacaacgtcgtgcggaagaagatcgagaacgccatcgccaactccctgatcaccttcaagatcgtgaagaagaagaaggtcgccgtgatcaaggagggcgtgaccatctggatgcgcgagcccaacatcgagaaggggatcgagggcatccccatcaagaaggtccggatcatcacgaacagcgtgaagaaccccatcgagatcaaggtgcactccccgctcagcaagtcccgccacaagcacaagcagaaggtctacggccagaacgacgagaactacgccatggcgctgtacgagctggacgggaagcgggagttcgagctcatcaacaacttcaacctggccaagctgctcaagcagagccagtcctactaccccctgcacaaggagaaggagatcaagggcaagaagatcctggtgcccatcgagaagcgcaacaacaaggacgtgatcctcaagcgggggcagcaggtcgtgttctacgacaagaccgtggagaaccccaaggacatcagcgagatcatcgacttccgcgagcggatctacatcatcgagggcctgaccatccagcgccagaaggacaagaagacctccaaggtcaacgagtacgggatcatccagctgcggcacttcaaggaggcccgcaagagcgaggagatctccaaggacaacttcaagccggacggcgagttcaagatcaacgagaacaagcccacgcggaagatgaaccacaaccagttcaccgccttcgtggagggcatcgacttcaaggtgctccccagcgggaagttccagaagatctga

SEQ ID NO: 2289 - RNA, 4614 nt, synthetic construct
  misc_feature 1..4614: note = Cas9 variant
  source 1..4614: mol_type = other RNA
atgaagaagatcctgggcctcgacctggggaccaacagcatcggctgggccctgaccacgaacgacttcgacaccaagaaggggaccatcgagggcctcgggtcccgcatcatccccatgagccaggacatcctgggcaagttcgactccggcgtgagcctgtcccagaccgcccagcggacggagtaccgcgggaagcggcgcctcgtccagcggttcctgctgcgccgggagcgcctccaccgggtgctgcacatcctggagctcctgccgaagcagtacagcgaggcgatcgacttcgacaagaagctgggccagttcaagcccgagcgcgagcagaagatctccttctacaagaacgagagcgggaagaaccagttcatcttcaccaagtcccaccaggagatgctcaccgagttccagacctactaccccacgatcaagaacatcccctacgactggaccatctactacctgcggaagaaggccctgaccgagaagatcagcaaggaggagctcgcctggatcctgctgaacttcaaccagaagcgcggctactaccagctccgcggggaggagaaggaggagaacaagaacaagaaggaggagttccacaccctgctggtgacggacatcatcgagcgggacaagggcaagtccggcacctggtacaacgtcatcctcgagaacgggtggatctacaagcgggagagcaagatctccctggccgactggatcggcaagaccaagagcttcatcgtgaccacggagtacaacgacgacgggtccgtgaagctgaccaaggacaacgaggagaagcgcagcttccggtccccgaaggaggacgactggggcctcatcaagatccgcaccgagaagaccatcaaccagagcgacaagtccgtcggcgcctacatctacgacgcgctgctgaagaaccccaaccagaagatcaagggggagctcgtgcggacgatcgagcgcaagtactacaaggacgagctgcgggagatcctgaagaagcagctcgagttccacagcgacgtgctgaacgacaagatcctgtacaagaagtgcatcgacgagctctacaagaacaacgacagccacaagaactccatcaaggaccgcggcttcgactacctgttcctggacgacatcatcttctaccagcgccccctcaagagcaagacctccctgatcagcgactgctccctggagttccggcccatcaagaacaagaacggggtcctcgtgaaggacaccgacggcaagcagatcgccaaggccctgaagtgcatcgcccgcagcaacccgatcttccaggagttccggctgctccagttcgtgaagaacctgaagatctacaagcgcggggtcgtggacgacgtggaggtcaccaacgactacctgaagtccgagaacgacgtggagaagctgttcaactggctcaacgacaaggcggagatcaaccagaagcagttcctggtgaacttcaagctgaaggaggacaagcaccggtggaacttcgtcgaggacaagggctacccctgcaacgagacgcgcaaccagttcctcaacgccatcgccaagatcgacgtggacaagagcttcttcaacaccaagaacacccaggacctgtggcacatcctgtactccgtgaccgacaagatcgagatcacgaaggccatcaccaccttcgccaagcggcacaacctccccaacgagttcatcatcaacttcagcaagatcaagccctacaagaaggagtacggctccttcagcgagaaggcgatcaagaagctgctgccgctcatgcgcttcgggtcctactgggacgccaagaacatcgacatcaagaccctggaccggatcgacaagatccagacgggcgagttcgacgagaagatccgcaaccgggtccgcgagaaggccatcgacctgcacaagatcgacgacttcaaggacctccccctgtggctggccagctacatcgtgtacgacaagcactccgaggccagcgacgtgtccaagtggaagacccccgcggacatcgagaagttcctcaagcacgagttcaagcagcacagcctgcggaaccccatcgtcgagcaggtcatcaccgagaccctgcgcgtggtgaaggacatctggctccagtacggggagggcaaggagaacttcttcaacgagatccacatcgagctggggcgggagatgaagaacgacaaggccacgcgcgagaagatctccaagaaggtgagcgagaacgagaacaccaacctgcggatcaaggccatcctcaccgagctgaagaacgacggcgtcagcgacatccgcccgtactcccccagccagcaggagatcctgaagatctacgaggagggcgtgtacaacaacgagtcccggaaggagaagctcgaggaggtggacaagatccgcaagaacgccaagcccaccaccagcgagatcatcaagtacaagctgtggctggagcaggggtacgcctccccctacacgggcaagctcatcccgatgagcgagctgttcaccaccaagtaccagatcgagcacatcatcccccagtcccgcttcttcgacgacagcctgtccaacaaggtcatctgcgagagcgaggtgaacgagctcaagtccaacatgaccgcgctggagttcatcctgacgaacgagaaccggatcgtgaccctcaccgggggcgagaccgtcaagatcttcacgaaggaggcctacaaccagcacatcatcagctactactccaagaacaagaacaagcagaagcgcctgctgaccgaggagatccccgagcagttcatcagccggcagctcaacgacaccaagtacatctccaagatcgtgaagaacctgctgagcaagatcgtgcgcgaggaggacgagcaggaggtcacctccaagcacgtggtgagcctcaacgggagcatcacgtcccggatgaagcaggactggggcctgaacgacgtctggaacaccatcgtgagcccccgcttcgagcggctgaacaccctcaccaactccaacgacttcggccagttcgagctgaagaaggacgcctacgggaacgagggcaagcgcgtgttccagacgaccgtcccggacgccatcgccaaggggttcaccaagaagcggatcgaccaccgccaccacgcgctggacgccctcgtgatcgcctgcgtgaaccggacccacatcaactacctgaacaacctgaacgccaaggacacggacgacaaggcggtcaagcacgagctccgcaacaagctgtgcttcaagaccaagcccgacagcaacggcaactacaagtgggagttccacaagccctgggagaagttcaccaaggaggcccaggacaagctgaacaccacgatcgtgtccttcaagcagaacacccgggtgatcaacaagaccgtcaacaagtacgtgagctacaaggacgagaacggcaacctcaacgtggacgccaacgggctgccccagaagaaggtcatcacccagacgaagggcgacaactgggccatccgcaagccgctgcacgccgagaccgtgtccgggaaggtgttcctcaagcggatcaagcagagccacatcaccatcgcgaacgccatcgagcaggtcgagctgatcgtggacaaggaggtgaagaagcagctgaaggccaagatcaagctctaccccaacaacatcgccggcctgaagaagcacctgaaggccttccccgtcatgatcaacgacaaggcgatcgacaagatccagatctacgagaccctcgaggccacggccacccgcaagatcctggacatcaccttcgacgagaagaagatccagaagatcaccgacacggggatccagaagatcctgctcaaccacctgaagcaggagaagtaccagaacaccgtggacgagaacggcaagaagctggccccgcacgagatcgccttctccgagaacggcctcgaggacctgaacaagaacatcaccttcctgaacgacgggaagaaccaccagcccatcaagaaggtgcggatcttcgaggagggcaacaagttccccctcggggaggtcggcaacaagatcaacaagttcgtggagaccgcgaaggggaccaacctgttcttcgccgtgtacgagaacgacgacaagaagcgcaactacaagacgatccccttcaacgaggtcatcgagcggcagaagcagggcctgaacgccgccctcgagatcgacgagaacggcaaccgcctgctgttcaccctcagcccgaacgacctggtgtacatccccctggaggacgagatcgggtacctcaacggcgtgtacttcaagaacctgaacaaggagcagaccgtccggatctacaagttcgtgtcctgcaccgggggcgaggggcacttcgtgcccaacaactacagcaaggagatcatctccaacgagaacggcagcaacaacaagaacgagcgcatgctgaacttcaacaacttcaacatcatcttcgacggcaaggagaagcccgtcatgatcaagtccatctgctggaagctcgaggtggaccgcctggggaaggtgatcaagatcatcaagtga

SEQ ID NO: 2290 - RNA, 4617 nt, synthetic construct
  misc_feature 1..4617: note = Cas9 variant
  source 1..4617: mol_type = other RNA
atgaagcacatcctgggcctcgacctggggaccaacagcatcggctgggccctggtgaagtccgagcaggactgcgacgacgtcgagcgcatcaacgggatcgaggccgcgggcagccggatcatccccatggacgccgccgtgctcggggacttcgccaagggcaacaccaagtcccagacggccgaccgcaccgcggcccggggcatccgccggatgggggagcgccacaagctgcggcgcgagcggctgaaccgcgtgctcgacgtcatgggcttcctgccggagcactacagcgccgccctgacccggtacgggaagttcaaggacggcgaggagtgcaagatcgcgtggcgcaaggacgagtccgggcagtggaccttcgtgttcgaggacagcttccgggagatgctcgccgacttcgtggcccaccagcccgagtggctggccggcggccgcaaggtcccctacgactggacgatctactacctgcggaagaaggccctctccaagcccctgaccaagcaggagctggcgtggctcctgctgaacttcaaccagaagcgcgggtactaccagctccggggcgaggacgagcacaccgacgacaaggggaagctggtggagtactacgccctgaaggtggtcggcgtggaggacaccggcgacaagaaggggaaggacacgtggttcaacatcatgctcgagaacggcatggtgtaccgccggccggccgccgaggcccccgactggatcgggaagaccaaggagttcatcgtcaccaccgacctggagaaggacggcacgcccaagaaggacaaggaggggaacatcaagcgcagcttccggatgcccaaggaggacgactggaccctgatcaagaagaagaccgagaacgacatcgaccgctccggcaagaccgtgggcgagtacatctacgacgcgctcctggccgacccgacgcagaagatccgcgggaagctggtgcggaccgtcgagcgcaagtactacaaggaggagctcaagaagatcatcaacagccagaagcggttcatccccgagctgaacgacaacgagctgtacggccgctgcatctccgagctctaccagagcaacgacgcctaccggcagtccatcagctcctgcgacttcacctacctgttcgtggacaacatcatcttctaccagcgccccctcaagagcaagaagtccctgatcgacaactgcccctacgaggagcacagctacaccgactccaagacgggggaggtgaagaccgccccggtcaagtgcgtggccaagagcaaccccctgttccaggagttccggctgtggcagttcgtgcagaacatccgcatcttcgagcggcagaagaagatcggcgacagcgtcaagaccgacgtggacgtgaccggggagttcatcaagtccgcggacgacgtcgtgagcctcttcgacttcctgaacgaccgcaaggacatcacgcagtccgtcctgctcggcacctacttcaagatcaagaagcccaagggcaaggacagcgactacccctaccggtggaactacgtggaggacaagacctacccgtgcaacgagacccgcgccctgatcctgaaggggctcaaggacgccggcatcgacgaggggttcctggacaaggacaaggagtactccctgtggcacatcctctacagcgtggaggacaagcaggagatcacgaaggccatggagaagttcgccgcgaagaactccctgggcgggaagttcgccgaggtcttcagctccctgccgcccttcaacaagaactacggcagctactccgagaaggccatcaagaagctcctggccctgatgcggaccggcaagtactggagcgcggacgccatcgacaagcacaccctggagcgcatcgacaagatcatcaacggggagtacgacgagtccatccggacccgcgtgcgggagaaggccatcaacctcacggacgtgagccacttccgcggcctgcccctgtggctcgcctgctacatcgtctacgaccggcactccgagagcaaggacatcacgtgctggaactgccccgccgacatcgaccagtacctggaccacttcaagcagcactccctgcgcaaccccatcgtggagcaggtcgtgaccgagaccctccgcaccgtgcgggacatctggcgccagtacgggaagatcgacgagatccacatcgagatgggccgggacatgaagaaccccgcggacgtgcgcgccaagatgagcaagcggatgatcgacaacgagaacgccaacctgcgcatcaaggccatgctggccgagttcgcggaccccgacttcggcatcgccggggtccggccgtactcccccagccagcaggagatgctccgcatctacgaggagggcgccctggagagcgtggacgaggtgcccgacgagatcaacgagatcatctccaagttcaaccagaccgacatcaagaagcggcccacccacggggagatcatcaagtacaagctgtggctcgagcagaagtaccagagcccgtacaccggccgcaccatctccctgagccggctgttcacggacgactaccagatcgagcacgtcatcccccagtcccgctacttcgacgacagcatgtccaacaaggtgatctgcgaggccgaggtgaaccagctcaaggaccggatgctggggtacgagttcatcaaggcccaccacggcgagaaggtcctgctcagctccggcgagaccgtgaccatcctgaccgcggaggagtacgagcgcctggtgcagctcaacttccggaagaaccccgtcaagatgaagaagctgctgatggacgacatcccggacaagttcatcgagcgccagctcaacgacagccggtacatctccaagaagatcaagagcctgctgtccaacatggtgcgcgacgagggggagcaggaggacatcagcaagaacgtgatcgcctgcaacggcgccatcacggaccggctcaagcgcgactggggcgtcaacgacgtgtggaaccacatcatcctgccccggttcgagcgcctgaacgccgtgaccgggtccgaccgcttcaccaccacgagcaccaacgggcacaccatccccgacatgcccctcaacctgcagaagggcttcaacaagaagcggatcgaccaccgccaccacgcgatggacgccatcgtcatcgcctgcaccacgcggtcccacgtgaacctgctcaacaacgaggccgccatgagcaagaacaacgcggtgcgctaccagctgagccggaagctgcgccggtacgaggacaccatggtcacccgcaacggcgagacccggacgatctccgtggcccgcgagttcctcaagccgtggcccaccttcaacgccgacgtggagaaggccctgcgggggatcgtcgtgagcttcaagcagaacctgcgcgtgatcaacaagaccgtcaacaagtaccagaagttcgtgtacaacgaggagaagcacatcaaggagaagaaggccgtgcggcaggaggagcgcaacggccggcacctcctggcgatccgcaagcccatgcacaaggacaccgtctacggggaggtgaacctgcggcgcatcaaggaggtgtccctcaaggacgccgtcgccaaccccaaggccgtggtggacaaggacctgaagaagaagctgatggccatgatcgagctcggctacgacctgaagcagatcacgaagtacttcgaggacaacaaggacgcgtggcaggacgtcaacctgaagaagatcaaggtgtactacttcaccaaggacaccggggaccggtacttcgccacccgcttcggcaacgacctcgtgacgctgttcagcaagatcaccaaggccgacgacgccaagaagcagatcgagcgcatcaccgacaccggcatccagaagatcctgaagcggcacctcgaggcgaacgggggcgactgccagaaggccttctccgccgacgggatcgacgagatgaaccgcaacatcacgcagctgaacggcgggcggccgcacaagcccgtctacaaggtgcgcatctacgagaaggccgacaagttcgccatcggcaccaagggcaacaaggcggccaagttcgtggaggccgccaaggggaccaacctgttcttcgccgtctacctcaaggagtacgaggacagcaccacgggcgagaccatcaagaagcgggtgttcgacaccatccccctgaagaccgtcatcgaccgcctgaagaacgggcagacgcccgcgccggaggagaaggacggcgccaagctcctgttcgtgctgtcccccaacgacctcgtgtacctgcccaccgaggacgtcgtgaagaacggcaccatcaaccggcccctggacaagcgccggatctacaagatggtgagctgcaccgggaccgagtgctactacatcccgttcatcgtcgcctcccccatcgtggacaaggtggagttcttcagcctcaacaagatcggccgcgccatcacgggggagatgatcaaggagatctgcatccccatcaaggtcgaccggctgggcaacatcaccgaggtgaacaacgagaagatctga

SEQ ID NO: 2291 - RNA, 4623 nt, synthetic construct
  misc_feature 1..4623: note = Cas9 variant
  source 1..4623: mol_type = other RNA
atgaacaagatcctgggcctcgacctggggaccaacagcatcggctgggccctggtggggaccgacgaggagggcaaccccatccgcatctacaagtccgggagccggatcatcccgatgtcccaggacgtcctcggcaacttcgaccgcggcaacagcatctcccagacggccgagcggaccagctaccgcggggtgcggcgcctgcgggagcgccacctcctgcggcgcgagcggctgcaccgcgtgctgcacctcatgggcttcctgccctcccactacgaggaggcgatcgggtgggacaagggcgacaacaagaccttcgccaagttctacagcgacaccgagcccaagctgccctggcggaagaacgccgagcgcgagcacgagttcctcttcaacacgccgtacaacgagatgctggtcgacttccggaagaaccagccccagctgttcaagatcaagaagaacgggcaggagtccctcatcccctacgactggaccatctactacctgcgcaagaaggccctgagcaagcccatctccaagaaggagctcgcctggatcatcctgaacttcaaccagaagcggggctactaccagctgcgcggcgaggaggaggaggagaacagcaacaagctcatcgagtaccacgcgctgaccgtggtgaaggtcatcgccgacgagccgcagaaggggaagtccgacatctggtacaacgccgagctggagaacggctgggtgtaccggcgcagctccaagacgcccctcttcgactgggagagcaaggtgaaggagttcgtcgtgaccaccgacctgaacgccgacgggtccctgaaggtggacaaggagggcggcgtcaagcggagcttccgcgtgccctccgaggacgactggatgctcgtgaagaagaagaccgagagcgacatcgagaagtccgacaagaccgtcgggtgctacatctacgacacgatcctgcagaacccctcccagaagatccgcggcaagctggtgcggaccatcgagcgcaagttctacaagaaggagctcaccgagatcctgaacaagcagaaggagttccacagcgagctgcagaacaaggagctctaccaggagtgcatcaaggagctgtacccgcacaacgaggcgcactacgactccctgctcgtgaaggactacaccgacctgttcgtcaacgacatcatcttctaccagcggcccctcaagagcaagaagtccctgatcagcaactgcccctacgagtaccgcgtgtaccggaacgactccgggatcgtggagcgcgtccccatcaagtgcatcgccaagagccacccgctgtaccaggagttccggctgtggcagttcatccacaacctccgcatctacgagcggcagcgcgaggtgaacggcaagcccgagacggacgtggacatcaccgccgagttcatccccaccaccgaggaccgggtcaagctgttcgactggctgaacaacaagaaggagatcaagcaggacacgctcctgcagtcctacttcaagatcaagaagaagaagggggacgacaagttcccctaccgctggaactacgtggaggacaaggagtacccgtgcaacgagacccgggccctgatcctcagccgcctgaccaagctgaacctgtccgaggacttcctcaccaaggagatggagctggccctgtggcacatcctctacagcgtcgaggacaaggaggagatcaagaaggcgttcaagtccttcgcccagaagcacaacctggacgacagcttcgtggaccagttcatcaagttcccgcccttcaagaaggactacggctcctacagcgccaaggccatcaagaagctgctccccctgatgcggatcggcaagtactgggacgagaaggccatctccgggaacacgcgcagccggatcctgtccatcaacgagcgcctcgaggacatgcggagcagcggcaagaagatcgaggacgtgtccgacgacgacatccccaagcaggtcctcaagagcttcgacaaggtgaacggggtgtactccggcctgaacacctaccaggcgtgctacgccgtctacgggcgccacagcgaggcctccgagatcaccaagtggaagacgccccaggacatcgacgactacctgaacgagttcaagcagcacagcctgcgcaaccccatcgtggagcaggtcatcaccgagaccctgcgggtggtgcgcgacatctggaagaagtacggcgacttctccgagatccacatcgagctcggccgggagatgaagaaccccgccgacaagcgcgccaagatgaccacccagatcagcgagaacgagaacacgaacctgcggatgaagtccctgctcgcggagctgaagaaccacaacgacgtggagaacgtccgcccgtacagcccctcccagcaggagatcctgaagatctacgaggagggggtgctcaacagcgtgtccgagatccccgaggagatcatcaagatcaccaagagctcccagccgagccagaccgagctggtccggtacaagctgtggctcgagcagaagtaccgctccccctacaccggcgagatcatccccctggggaagctgttcacgagcgcctacgagatcgagcacgtgatcccccagagccggtacttcgacgactccctcagcaacaaggtgatctgcgagtccgaggtcaacaagctgaagggcaacctgctcgggtacgagttcgtgaagaaccaccacggcgtgaaggtcgagctgaacttcaacaagaccgtggagatcttcagcatcaacgagtacgaggagttcgtgaagggcaactacgggaagaaccgcggcaagatgaagaagctgctcctggaggacatcccgaagtccttcatcgagcggcagctgaacgacacccgctacatcagcaaggtcgtgaaggggctcctgtccaacatcgtgcgggaggacggcgagcaggaggccaccagcaagcacgtcatcccctgcaccggcggggtgacgaccatcctgaagcaggactggggcctcaacgacgtgtggaacaagatcgtcacgccccgcttcgagcggatgaacgagctgaccaacacctccctgttcgggcagtgggagaacaaggagggcaagcgcatcttccggaccgaggtgcccctcgagctgcagaaggggttcaacaagaagcgcatcgaccaccggcaccacgccatggacgccatcgtgatcgcgtgcgccacccgcagccacgtcacctacctgaacaacgagtccagcaaggccaacgccaaggagatccgggacggcctcaagcacaagctgtgcttcaagtccaagacggacgagaccggcaactacaagtggcagttccacaagccgtgggacaccttcacccaggacgtgcaggacacgctggagaacatcgtgatcagcttcaagcagaacctccgcgtcatcaacaagaccaccaaccgctaccagaagtacgaggaggagaagaagatcctgaagtcccaggagaagggggacagctgggcgatccggaagcccctgcacaaggacaccgtgttcgccaaggtgtccctccagaagatcaagtgcgtcaagctggccatggccctgaaggactggaagaacatcgtggacaagcagctcaagaaggagatccgccggctgatcctgagctacggcaagttcgacgccgagatcctcaacaagtacttcaaggaccgcaagtacatcttcaaggacgtggacatctccaaggtcgacgtgtactacttcgagacggagtacgtggcgacccggaagaacctggacaccagcttcgaccgcaagagcatcgagtccatcaccgacacggggatccagaagatcctgctcaaccacctgggcgtcaagaacaacaaccccgagctggccttcagcgccgaggggatcgacgagatgaaccagcggatcgtggagctcaacggcggcaagcagcaccagcccatctacaaggtgcgcatgtacgagccgctggggaacaagttccaggtcggccggatcgggaacaagaaggacaagtacgtggaggccgcccccggcaccaacctgttctacgcgatctaccagtccgaggacaagaagcgcatctacgacaccatccccctcaacatcatcatcgagcggcagaagaaggagctgttccccgtgccggagaacaaggaggacaaggacaacctgtacaagctcctgttctggctgagccccaacgacatggtctacctccccaccgagaaggagtgggccaaccccgacctgttcaacttcaacaacatgacgaagaaccagcgcaagaagctgtacaagttcatcgacgggtccggcaccaccgccaacttcatcccgaacaccgtggccaacatcatcttcagcatccccaagaaggactccggcaagtacagcatggggaaccggatcgtccagaacgagttcggcatcgggagcccccagagcaagaaccagaaggccttcacgggcgagatgatcaaggagcgctgctggaagctcaagatcaaccggctgggggacatcatcgagtgcatcaagtga

SEQ ID NO: 2292 - RNA, 4629 nt, synthetic construct
  misc_feature 1..4629: note = Cas9 variant
  source 1..4629: mol_type = other RNA
atggagaagcgcatcctgggcctcgacctggggaccaacagcatcggctgggccctggtgaagggggagcggcacgagaacgacaacgagaccatcctctcctacatcgaggccgcgggcagccgcatcctgcccctggacgccgccgcccagggggacttcgagaagggcaacccggccaagacgcagacctccgagcggacccgcatgcggggcatgcgccacctcctggagcggagcctgctccgccgggagcgcctgcaccgggtcctggacatcatggacttcctcccgccccactactcccagagcctgacccgctacgggaagttcaaggcggacacggagtgcaagctggcctggcggaagaccgagaccggccactacgagttcctcttccaggactccttccaggagatgctgcaggacttccagaaccacgggaagctggaggagaacaagaagatcccctacgactggaccatctactacctccgcaagaaggccctgacgcagcccgtgagcaagcaggagctggcctggatcctcctgaacttcaaccagaagcggggctactaccagcgcgaggaccaggcggtggacgacaaccagaagaagcgggtcgagtaccaggccctgaaggtgatctccgtggaggacaccggggagaagaagggcaagaacacctggtacgacgtccgcctcgagaacggcctggtgtaccactacagcgcccccatcaagcccgactggaagggggagaccaaggagttcatcgtgacgaccaccatcgaccagaacggcaagcccgagctggacaaggacgggaagccgaagtactccatgcgggcccccaaggaggacgactacaagctcctgatggagaagaccaagaaggacatcacggacagcggcaagtccgtcggcgagtacatctacgacgccctgctcgtgaacccccagcagaagatccgcgggggcctggtgcggaccatcgagcgctacttctacaagaaggagctggagaagatcctcctgagccaggagcgcttcatccccgagctgaccgaccgggagctctaccgccggtgcgtcgaggagctgtacccgtccaacgacgcgtaccgccacctgatcgagagccgggacatgcgctacctcctggtggaggacatcctgttctaccagcggcccctcaagtccaagaagtccctgatcgacgactgcccctacgagagccgcagctacgtggaccgggagaccggggagatcaagagctcccccgtcaagtgcatcgcccagagccacccgctgttccaggagttccgcctctggcagttcatccacaacctgcggatctaccagaacgagcgctccgtggagggcaagctgcagctcgacgtggacgtcacggaggaggtgctgcccacccccgagagcaaggccgccctgttccggttcctgaacgaccgcgagaacgtgacccaggagatcctcctgaaggaggtcttcaaggggcggaagctgtccgtgaaggactgcccctaccgctggaactacgccggcgagggcaagaagtacccgtgcaacgagacccggcacctcatgctgaagctgctcaagaaggcggggatcgacacggccttcctgacccccgagaaggagcaggccctgtggcacatcatgtacagcgtggaggacaaggaccagtacgagaaggccctctccaccttcgcccgcaagaacgacctgcccgacggcttcaaggagcagttcaagaaggcgcccaccttcaagaaggactacggggcctacagcctgcgggccatcaagaagctcctgccgctgatgcgcgtcggcgagtactggtccgccgactgcatcgacagcgagacgaaggagcgcatctcccagatcatccgcggggagatggacgagaaggtgagccagcggatgaccaagtcccgggacagcttcaccgacatctcccagttccagggcctccccgtctggcaggcctgctacgtggtgtacggccgccacagcgaggcgaccgagatccagcggtgggagaagcccgaggacatcgacgtctacctgaaggccttcaagcagcactccctgcgcaaccccatcgtggagcaggtcgtgctcgagacgctgcgggtggtgcgcgacatctggaagacctacgggaaggtcgacgagatccacatcgagatgggccgggacatgaagaacaccgccgaggagcgcaagcggatcttcaaccgcaaccagcagaacgagaacgacaacctgcggatcaaggccctcctgaccgagttcatgaacccggacttcgagatcgagggggtgcgcccctacagcccctcccagcaggaggcgctgcggatctacgaggacggcgcctggagcgggctcgacgaggagaaggaggacaagaaggagctggaggccatccgcgagatcctgggcaagttcagccagtccgacaaggccaagcggccgacgcacagcgaggtgctccgctacaaggcctggctggagcagcggtactccagcccctacaccggcgaggcgatccccctggccaagctgttcacccccgcctacgagatcgagcacgtcatcccgcagtcccgcttcttcgacgacagcttctccaacaaggtggtgtgcgaggccgaggtcaacaagctcaaggaccggatgctggggtacgagttcatcaaggcccaccagggcgaggtggtgagcctctccgggaccggccgctgcgcgcgcatcctgagccccgaggagtacgagcagcgggtcaccgactgctacaagcacaacacggccaagatgaagaagctgctcatggaggagatccccgacgacttcatccagcgccagatgaacgactcccggtacatcagcaagctggtgaagtccctgctcagcaacatggtgcgcgaggagggcgagcgggaggccatctccaagcacgtcatcacgtgcaacgggaccatcaccgaccgcctgaagaaggactggggcgtgaacgacgtgtggaaccacatcatcctgccccggttccagcgcatgaaggacctcaccgggcggaacgacttcgtcgccgtgaacagccagggccacgagatcccgtccgtgccgcccgagctgcagaaggggttcaagaagaagcgcatcgaccaccggcaccacgccatggacgcgatcgtcatcgcctgcaccacccgcaaccacgtgaacctgctcaacaacgaggccgccatgagcgagaacaaggcgaaccggatcgccctgagccgcaagctgcggcgctacgagaactgcgccatctacaagggcggcgagaccaagaacatctccgtggccaaggagttcctcaagccctgggccacgttccccgcggacgtcgagcgggccctgggggacatcgtggtgagcttcaagcagaacctgcgcgtcatcaacaaggccaccaaccactacgagcactacaaggacggcaagaaggtgaaggtgccccagaagaagggggacatgtgggtcgtgcggaagcccctccacaaggacaccgtgtacgccctggtcaacctgcgcaacgtgaagaccgtgggcctcaaggacgccatcctgatgcccgaccgcatcgcgaacaaggacctgaagaagaaggtcaaggagctcctggcccagggggacgacctgaagaagatcaagaagtacttcgagacggagaaggacacctggcaggacgtggacgtgaagaagatcgaggtctactacttctccgaggagaccgccaaccactactacgccacccggaagccgttcgacgccaacgtgaagatcgacagcgtgacggacaccggcatccagaagatcctccgccggcacctggaggagaacggcaacaaggcggacgtcgccttctcccccgaggggatcgcccgcatgaacgagaacatcttccggctgaacggcaacaagcaccaccagcccatctacaaggtgcgcgtgtacgagaaggccaacaagtaccccgtcgggcagaccggcaacaaggcgagcaagttcgtggaggccgccaaggggaccaacctctacctggccgtctacgagtccgaggtggtggacaagaagacggccgagatcagcaagaagcggtcctacgtcatcgtgccgctgcgcgacgcggtggcccggcagaagcagggcgtccccgtggcccccgagcgcaacgaggagggcgggaagctcctgttcgtgctgagccccaaggacttcgtctacgtgccgaccgaggaggagcggtccaagggcgaggtgctcctgcccctggacaagaaccgcatctacatcatgatggacgccagcgacgggatcgtcaacttcctcccctactccgtggccaacctgatctacgcgctgccgaaggaccaggccagcggcttctgcaccgacgggcggatgatccagaacgagttcggcctcggctcccccaagagcaagaacgagcgcgccctgaccggggagatgatcaaggagatctgcctgcccgtgaaggtcgaccggctcggccgcatcacggagatcaacgggaacaaggtgtga

SEQ ID NO: 2293 - RNA, 4644 nt, synthetic construct
  misc_feature 1..4644: note = Cas9 variant
  source 1..4644: mol_type = other RNA
atgaagaagatcctgggcctcgacctggggaccaacagcatcggctgggccctgaccaacaacgacttcgacaacaagctcgggtccatcgagggcctggggagccgcatcatccccatgtcccaggacgtgctgggcaagttcgacagcggcgtctccatcagccagacggccgagcggaccaagtaccgcgggacccggcgcctcgtgcagcggttcctgctgcgccgggagcgcctccaccggatcctgaacatcctggacttcctcccgcgccactactccgaggcgatcgacttcgacaagaagttcggccagttcaagcccgagcgggaggagaagctgagcttctacaagaacgagtccgggaagaaccagttcctgttcctcgagagccaccaggagatgttctccgagttcaagctgacccaccccgacctgaagcaggtcccctacgactggacgatctactacctccgcaagaaggccctgacccagaagatcagcaaggaggagctggcctggatcatcctcaacttcaaccagaagcggggctactaccagctgcgcggggaggaggaggaggtgaacaagaacaagctggaggagttccacaccctcgtgatcgtggacgtcatcgagcgggagaagggcaagtccggcgtgtggtacaacgtgatcctggagaacgggtggatctacaagcgcgagagcaagatcgccctgttcgactggatcggcaagcagaagaacttcatcgtcaccacggagctcaacgacgacgggaccatcaagctgaacaaggacaacgaggagaagcggtccttccgcagcccgaaggaggacgactggggcctgcggaagatccgcaccgagcagaccatcaaccagtccgagaagtccgtgggcagcttcatctacgacgagctcctgaagaagcccaaccagaagatcaagggggagctggtgcggacgatcgagcgcaagttctacaaggacgagctcagcaagatcctgaaggcccagatcaccttccactacgagatcctgggcgaccgcaacatctacaagaagtgcatcgacgagctctaccggcacaacgacagccacaagaacaacatcaaggacaaggggttcgactacctgttcctggacgacatcatcttctaccagcgccccctcaagtccaagaccagcctgatctccgactgcagcctggagttcgtccccatcaaggacaagaagggcatcctcgtgaaggactccaacgggaagcaggtcgtgaagccgctgaagtgcatcgccaagagcaaccccatcttccaggagttccggctgctccagttcgtgaagaacctgaagatctacaagaaggagatcatcaacgagatcgacgtgaccaacgactacctgaagacggaggaggacctcgtcgagctgttcgactggctgaacgacaaggcggagatctcccagaagcagttcctggcctaccccaagttcaagctcaaggaggacaagtaccgctggaacttcgtggaggacaagatctacccctgcaacgagacccggaaccagttcctgaacgccatcgcgaagatcgacgtgaacaagagcttcttcgacgccaagaacacccaggacctgtggcacatcctctactccgtcaccgacaagacggagctgttcagcatcaacaccgagaccggcatccagtccggcgccctgagcaccttcgccaagcgccacaacctctccaacgagttcgtgagcaacttctccaagatcaagccgtacaacaaggactacgggagctactccgagaaggccatcaagaagctgctgcccctcatgcggttcggcagcaactggaacaagaacaacatcgacgcgaagacgctggcccgcatcgacaagctgcagaccggggagttcgacgagaccatgcggacccgcgtgcgggagaaggccatccacctctccaagatcacggacttccagggcctgcccctgtggctcgccagctacatcatctacgaccgccacagcgaggcctccaacatcagcaagtggaagacccccgaggacatcgcgtggttcctgaacccgaagaacaagtccgggttcaagcagcacagcctgcggaaccccatcgtcgagcaggtcatcaccgagaccctccgcgtggtgaaggacatctggcagcactacggcgagggcaaggagaacttcttcaacgagatccacatcgagctggggcgggagatgaagaacaacgccaacgaccgcaagcggatcacggagaccatcaaccagaacgagaacaccaacctgcgcatcaaggccatcctcaccgagctgaagaacgacggcatcaacgacgtgcggccctactcccccagccagcaggagatcctgaagatctacgaggagggggtctacaactccgagatccgcaaggagaagctcgaggacatcgacaagatccgcaagaacgccaagccgacgcccagcgagatcatcaagtacaagctgtggctggagcagggctacatctccccctacaccgggaagctcatccccctgagcgacctgttcaccaccaagtaccagatcgagcacatcatcccgcagtcccgcctcttcgacgacagcctgtccaacaaggtgatctgcgagagcgaggtgaacgacctgaagggcaacaacaccgccctcgagttcatcctgaagaacgagggccggatcgtcctgctcaccgggggcaagacggtgaagatcttcaccaaggaggcgtacaaccagcacatcacctcctactacatcaagaacaagagcaagcagaagcggctgctgacggaggagatccccgagaagttcatcgaccgccagctcaacgacaccaagtacatctccaagatcgtgaagaacctgctgagcaagatcgtccgggaggaggacgagcaggaggtgaccagcaagcacatcgtgtccctcaacgggagcatcacctcccgcatgaagcaggactggggcctgaacgacgtctggaacaagatcgtgagcccccggttcgagcgcctgaacgccatcacgaactccaacgacttcggcaagctcgagctgaagaaggacgagttcgggaacgccggcaagcaggtcttccagaccaccgtgcccgacgacatcgccaaggggttcagcaagaagcggatcgaccaccgccaccacgccctggacgcgctcgtgatcgcctgcatcaaccggacccacatcaactacctgaacaacctgaacgccaaggacgagaacgacaagacgatcaagcacgagctccgcaacaagctgtgcttcaagaccaagccggactccaacggcaacagcaagtgggagttccacaagccctgggagaacttcaccaagaaggtggaggacgagctgaaccagaccatcatctccttcaagcagaacacgcgggtcatcaacaagaccgtgaacaagtaccaggtgtggaaggaggaggacggggccatgaagaaggtcaccgtgaagcagaccaagggcgacaactgggcgatccgcaagcccatccacgccgagacggtgagcggcaaggtcttcctcaagcggatcaagcagtcccacatcaccatcgccaacgccatcgagcagatcgagctgatcgtggacaaggaggtgcgcaagcagctgaaggccaagatcaagcagtacccgaacaacaaggaggggttcaagaagcacctcaaggcgttccccatcatgatcaacggcaaggccatcgacaaggtccagatctacgagaccatcgaggccaccgccacgcgggagcgcaacaacctggacatcaccttcgacgagaagaagatcgagaagatcaccgacaccgggatccagaagatcctgctcaaccacctgaagcaggagatctaccagaacgccatcgacgagagcggcaagaagatcgcgccccacgaggtggccttctccgagatcgggatcgacgagctgaacaagaacatcaaggtgctcaacaacggcaagaaccaccagcccatcaagaaggtccggatcttcgaggagagcaagcgcttctccctgggccagagcgggtccaagacggacaagtacgtggagaccgccaagggcaccaacctgttctacgccatctacgaggggaagaagggcaaccggaactacaagaccatcccgctcaacgaggtgatcgagcgccagaagcaggggctgaacagcgccctggtcacggacgagaacgagaaccgcctcctgttcaccctgtcccccaacgacctcgtgtacatccccaccaacgaggagaagaagaacctgaccacgatcaacttcgacaagctgagccgggagcagaccgagcgcatctacaagttcgtgagctgcacctccggcgagggccacttcgtcagcaacaactactccaaggagatcatcagcaacgagaacgggtccaacaacaagaacgagcggatgctcgagttcaacaacagcaacaccatctacgacgagaaggagaagcccgtgatgatcaagtccgtgtgctggaagctggaggtcgaccgcctgggcaagatcaagcggatcatccgctga

SEQ ID NO: 2294 - RNA, 4677 nt, synthetic construct
  misc_feature 1..4677: note = Cas9 variant
  source 1..4677: mol_type = other RNA
atgaagaagatcctgggcctcgacctggggaccaacagcatcggctgggccctggtgaacgtcgacaagaacgggaaccccttcggcatcgaggggctcggctcccgcatcatcccgatggaccaggccaccctgagcgacttcgagaagggcaactccaagagccagacggcggagcggaccatgttccgcggggcccggcgcctgcgggagcgcaagcacctccggcgcgagcggctgcaccgcatcctgaacgagctcaacttcctgcccatccactaccggtcctgcatcgacttcgtgcaccgcctgggcaagttcaaggccaaccacgagcccaagatcgcctggcggagcaacgaccaggacaagatggagttcatcttccagaactccttcctcgagatgatgagcgacttcaccaagcgccagcccgagctggtgaaggaggggaagaagatcccgtacgactggaccatctacttcctgcggaagaaggccctcggccagcgcatcgagaaggaggagctggcgtggctgctcctgcacttcaaccagaagcgggggtactaccagctgcgcggcgaggacgagatcgacgccacgcggtccgccaagacccgcaagtacttcgaccggaagatcatcaagagcatcatcgacaccggcgaggagtacaaggggctcaaggtcctgatcgtggagctggacaacggcaaccaggggaagatcttcaagcaggaggtgcccgactgggtcggccaggagaagaacatcatcgccaccgtggacctcgacaaggacggcaaggaccgcttcgacaagggggtgctgtcccagcgcttcagcatcccctccgacagcgagtgggagacggagtggaagctgatcaagctcaagaccgaggaggacctggaggcgtcccagaagaccgtcggcacctacatctacgacagcctgctcaagaaccccaaccagaagatcaaggggaagctggtgcggacgatcgagcgcaagtactaccgggacgagctgcgcgccatcctcaacaagcagcgggagttccacccggagctgaacgacaagaagctgtaccagcactgcatcttctccctctacccccagaacgaggccttccgcaacagcatcgccaacaaggacttcacctacctgttcctggaggacatcatcttctaccagcggcccctcaagtccaagaagtccaccatcaacaactgcgcctacgaggtgcgccggtacatggacaaggagaccaaggagctgaaggaggtccccctgaagtgcatcgccaagagccacccgatcttccaggagttccgcctctggcagttcatcagcaacctgcggatctacaagaaggacatcacggacatcgacgtgaccaacgacttcctgcacagccaggacgactacgcgaacctcttcgagtggctgaacaacaagaacgagatcgaccagaaggccttcctgaagtaccccgccttcggcttcaagaaggacgccgtgaactaccgctggaactacgtcgaggacaagtcctacccctgcaacaagacccggagcgcgatcctctccaagctggacaagcacgagcaggagttcctgaccaaggagctggagctcaagatctggcagctgctgtacagcgtgaactccaaggaggagatcgacaaggccctcaacgtgaacagccccaagatcaacaacaagatctccatcgaccacacggggatcctgcacgagctcaagagctccagcctctccgacatcagcatccagcgcctgaaggccatcaacttcgaggagaaggactacggctcctacagctacaaggccatcaagaagctgctcgccctgatgcggcagggcaagtacttcgacaacaccgcgatcaccgacgccaccaaggcccgcatcaactccatcttcgaccggctggagagcatctccttcgacccggagcgcatcaacagcatcagcgacgacgacatccccaagcagatcctcaagtccttcatcaagctgaaccggacgtacgggggcttcaacacctaccaggcctgctacgccgtctacgggcgccacagcgaggcgaaggagatcgccaagtgggagaagcccgaggacatcgaccagtacctggccaagttcaagcagcactccctccgcaaccccatcgtggagcagatcatcaccgagaccctgcgggtggtccgcgacatctggaagaagcacgcctacaagacgatcaacaaggacaaccagggcaacaactgcgagagcgagtccgagctgaccgagatccacatcgagctcgggcgggacatgaagaacaacaagagcgagcgcctgcggatctcccgcatcaacagcgagaacgagaacaccaacctgcggatccgcaagctcctgatcgagttcaacgacccggagttcggcgtggagaacgtgcggccccactcccccagccagcaggagatcctgcgcatctacgaggacggcgtcctcaagtccggggtggagatccccgagtacgtcgacaacatcatcaagaagttcaaggagaccgacgtgaagaagcagccgagcaagtccgaggtgctgcggtacaagctgtggctcgagcagaagtaccgcagcccctacacgaacgaggtcatccccctgggcaagctgttcaccaacgactaccagatcgagcacatcatcccccagtcccggtacttcgacgacagcttctccaacaaggtgatctgcgaggcggaggtgaaccagctcaaggagaacgagctggggtgcgagttcatcatgaacaacggcgggcgcatcgtcgagctgagcttcggcaagaccgtgcggatcctcgacttcgaggcctacgagcagttcgtgcagcagaactacgccggcaaccgcccgaagctgcggaacctgctcatgaccgagatccccaacgacttcatcgaccgccagctgaacgacagccggtacatctccaaggtcgtgaaggggctgctcagcaacatcgtgcgcgaggacggcgaggccgagtccacgagcaagaacctgatctcctgcaccgggggcgtcaccgcccggctgaagatggactggggcctcaacgacgtgtggaacaacctgatctacccccgcttcgagcgcctgaacgagctcaccaacagcaaccagttcgggtactgggacaagaaggacggcaagaacgtgttccagacccaggtcccgatggacatccagaaggggttcaacaagaagcggatcgaccaccgccaccacgcgctggacgccctggtgatcgcctgcgccacgcggtcccacatcaactacctcaacaacgagagcgccaagtccaacagcaaggagtcccgctacgacctgcggcgcaagctgcggcgcctcgaggtgatccagaaggagtacaccatcaacggccggaaggagatccgcaacatcgaggtcgcgaaggagttctacaagccctggaacagcttcacccaggacgcccagtccgccctggagaacatcgtggtgagcttcaagcagaacctgcgggtcatcaacaagaccacgaactacttcctccgcttcaacaaggaggggaagaagatcttcgagacccagacctccggcagcaactgggccatccggaagcccctgcacaaggacaccgccttcggcctggtgaacctcaagcgcacgaagaccgtgtccctggcgaacgccatcctggactacgaccagatcgtcaaccggaagctctggaccaagatcaaggagctgatcagcatcgggtacgacaacaagcgcatcctgaagtacttcaccgacgacaaggagaactggaacgagatcatctccagcggcatcgaggtgttctactacacggacaacttcgagaagcaggtcgccacccggaagcccctcgacaccagcttcaccgagtccaagatcatcaacagcatcacggacctggggatccacaagatcctgctcgcccacctccgcgcgaacgagggcaacccgaacatcgccttctcccccgaggggatcgagaccatgaaccggcacatctgcgagctgaacggcggcaagttccaccaccccatctacaaggtgcgcgtgcacgagcccctggggtacaagttcaaggtgggcgacaaggggaaccgcagcaccaagtacgtcgaggccgccaagggcaccaacctgttcttcgggatctacatcaactcccagggcatccggagctacgagacgatcccgctgaacgtggccatcgagcgccagaagcagggcctctcccccgtgcccgacaacaacgagctgggggagcggctgctgttctggctgagccccaacgacctggtctacctcccgacctccgacgaggtggagagcggcatctgctgcaacaagctggggatcgaccgcatctacaagatggtgtcctgcaccggctacgtcggggacttcatccccgcgcacatcgccaaccccatcatccagaccctggagctcggcagcaacaacaaggcccagcgggcctggacgggcgagatgatcaaggagatctgcatccccgtgaaggtggaccgcatggggaacatcgtcgagatcttcaaccggaacaagaactga

SEQ ID NO: 2295 - RNA, 4695 nt, synthetic construct
  misc_feature 1..4695: note = Cas9 variant
  source 1..4695: mol_type = other RNA
atggccaagatcctgggcctcgacctggggaccaacagcatcggctgggccatcgtggacgacaagaactccaagatcctggacaccggggtccgcatcttccccgagggcgtggtggcgaagacgatcgggagcggcgacaaggaggagtccaagaacgccaagcggcgcgagagccggcagacccgccggggcttctaccgcaagcggctccgcaagatcaagctgctgcggaccctcatcaacttcaagatgtgcccgctggagcacttcgagctggacgtctggtccaagtgggacaagatcaagaagaaggaggggcgcatggcccccgagctgttcctgcccgagaacagcgcctacaacctgtggctcaagcagaacccctacatcctgcgggacaaggccctgtccaaggacctcaccctgacggagttcggccgcgtgctgtaccacctcatccagcggcgcgggttcctgagcaaccggaagggcaaggacgacgggaagatctacggcggcaaggaggggatcgtgggcatcgacaagaccaacgagcagatcaagaactccaccctggggaagttcctcttcaagatcctgccgaaggagggcgagcccttcaagatcatcgaggacgagctgggcaacgagctccgcgtccggagccgctacaccctgcgggacatgtacatcgcggagttcgaggccatctggaaccgccaggccaagcacctggggctcgacaacatctactactccaacgtgaagaacgtgctgctgaagggcagcctcaagaacaagaagaacgagcggaagatcaaccacctgaagaagatcaaggggaacggcaacatcgagatcatcacgctgaacaacaacctctccaagaacgagaagcccaagtacctgctgaagatcgccaccaagctccccctgaaggagttcctggcggggcgcatcgagaaggacgaggacggcaagatcaagttcaagagcaacgagtccgtcctcttctggcagcgcccgctgcggagccagaagaagctgctcgccaagtgccgcttcgagcccgacctgaaggacgacaacggcaagttcatccagaaggggaagaccccctgccacctgtcccaccccctctacgaggagtaccgggcctaccagtacgtgaacaacatcgagtacggcaagaagcagcgcctggaggagagccagcggaagcaggtcatcgacctgatcaactccaaggacgggaacttcaagttcagcgagatcaagaagaagctcaagctgagctacgagaccttcaactactccgacgacagctccgtgaacggcaactacatgatcaagaacctgaacagcatcttcccgaaggagatcctggagaaggagttcgtggtgaacgtcaacaaggaggacatcatcgagtacgggtacgagcgcatctggcacctcttccacttctgcgaggacaacgacgtgctgatcaagaagctgcaggacaacttcgacctctccgagaacgacatcgagaagatcagcaagatcaacctgaaggagggctactccaacgtgagcctgaaggccatcaagaacatcctcccctacctgaaggagggcaagctgctctccgacgccgtcatcctcgggggcgtgcggaacgtgttcgggaagaagtggcacgagttcatcgacttccacgagaagatcgagaaggacatcctgtacatcaaccaccagaagtccaacaaggagggcgaggcgatcgagaagatcaagaagtacctcatcgactacaagttcgggttcacggagaacgacaaccgcttcaagaagctgtaccaccacagccaggacgtcgtggaggtgaagctgcagaagaagatcggccccgtcgaggacctccggaaccccatcgtgcagcagggcgtcaacgaggtgcgccggctggtgaacgagctgctcgacgtccacgggaagttcgaccaggtgcgcgtggagctgggccgggacctgaagaacaacaagagcaagcgcgaggagatcgggtacaagatccgggagaacaccgccaagaacgagaaggccaaggagctcctgatcgagtacggcctgcgccagtcccgggacaacgtccagaaggtgctcctgttccaggagatgctggaccgcggcaccgtggccgtctgcccgtacaccaacaagacgatcaacatcagcgacgtgctcgggaacgagaacaagatgcagatcgagcacatcatccccaagtccatcagcctggacgactccttcgccaacaagaccctgtgcgacagcaagttcaacggcctcaagggggagcggaccccctacgagttctaccagatcaacaacgacgcgaacctgtggggcgggtccaagagctgggaggagatcgagcgccgcaccttccggatcctgccctacagcaaggccaagcgcttcacgtccaagaccaagttcgagaccaacgacttcatccagcggcagctcaacgacacccgctacatcagcaagaagacgaaggagatcctgtcccagatctgcgaggacgtgcgggtcatgccgggcagcctgaccgccgagctccgcaagctgtggggcctgaacaacatcctccaccccgccttcgtgctggacctgcccgccctccacatcgacgcgaacaagcacatcccccactacgtggtcctggacgaggacaacgtgccgatcctgtcccagcggatctacaacgacaagcccatcctcaaggccaaccagaccagcatcaccgggttcgtggacaacgagatcttcaagtccaaggagaagtacgtcaagttcgaggtgaaggcccccaacctgagcaacggcgagtactgggccaagctgctcctgtccaaccccaagagcatcgtgcgcgtcttcaaggagaagccgaagtccacggagaacgagatcgtggtgcgggggaagatcgagaaggagaagttcaagcacgagggcctgagcgggatcaacgccgagggcaaggagaacggcacctactgggcgaagctctccatcgtcgacaagaagttcaagaagcccaagaaggacgaccagcccaagaagaacgggaagcagatcctgctgttcggcgccgtgaaggagggggtgttcagctcctacatgtacgagtgcgacgccgacctcgaggacggcaagtactggctgatcctggacatcgacttcgagaacgtcgagttcgagaaggccctcaacgagcgcccggaggtgctggagaaccagatcctgatccaggggatcaccaacgacgagaacgtgttcgtcagcgacatggactgccagcaccagttcctcatgaacgagggcaagggcaagtactacgtgctgttcgacatcatctccgaggtgaacgagttctaccccatcaagaccaagagccccgagctggagaacgggcagagcctcacggagggcaccatctgggtcgacaagtacaccggggagatcaagttcgaccccaagaagaaccgggaggaccaccgccaccacgcgatcgacgccctggtgatcgccctgaccaaggagacgtacttccagcagctctcccggcgcaacgccagctccgagaacaagaagcggggcaacgagtacgagaaggagcagctggacttcgccgagccgtggaaggagttccacgtggacgcgcagaagtccatcaacagcatcctgatcagccacaagcagaacaagaacatcctcaccaagatcaccaagaagatcaccaagaacgggaagacctacaagtccgagggcatgagcgtccgcggccagctgcacgacaagacgtactacgggcacaacaagaactgcaaggccgacgagtacgtgtaccgggtggacatcaacaacctgtccttcagccagctcaccaacatcatcgacctgaacctgaaggccgtcatcgtggagggcgtgatcaagaagttcgaggagtccgagaagctcctgttcaagaagatgaacagcaaggtccagaacctggacaagtccaaggtgaagaagatcaaggccaaggtggacaagatcctcaaggagaccagcttcttcatgcccaacgaggggaagcgctacatccggctgaacatcatcgagcccgccaacttcgagcgcatgcccgtcccgatcaagaaggtgcggatccgcaaggtgctgcgcaacgcggagaagctcaacaacgagatcaagcagttcgtcgacccccagaacaaccaccacgtgctgatctacaaggacgagaacggcaacctgaaggaggaggtggtcaccttctggacggtggtcgagcggaagcgcaccggcgagcccgtgtacaagctcccctccgacgggaagaagatcgtgaccaccctgcagatcaacgacatgttcctgctcggcctgaacgaggacgagatcaactgggagaacccgaactacaaccacctgaaggagcacctctaccgggtccagaagttcacgagcggggacttctacttccgcatcgccaagacctccagcatccagaacggcgaggagaagcagcagatcaactccttcgggctgggcaagaacggctggctgacccacaaccccatcaaggtgaagatcagcgtgagcgggaagatcctcaaggtctga

SEQ ID NO: 2296 - RNA, 4713 nt, synthetic construct
  misc_feature 1..4713: note = Cas9 variant
  source 1..4713: mol_type = other RNA
atggagaacagcaacaactccagcaagaagtactacctgggcctcgacatggggaccgactcctgcggctggtgcgtgaccgacgacaagtacaacatcatccgcagccacaagaagatctacgggcccgacggcaagctggtcaagcgggaggggtgccacctgtggggctcccgcctcttccggccggccaacacggccaagagccgccggctgaaccgcaccgcgcggcgccggctggcccgccggcgccggcgcatcatcctcctgcgggagctgttccagcccgagatcgacaaggtggaccccaacttcttccgccggctcgaccagtccaacctgtggaacgaggacaaggacaaggagctgcagatggagcacaacttcctcttcaacgacaaggacctgaccgacaaggagtactacaaggacttccccaccatctaccacctccgcaaggccatggtgaacggcctgacgatcaacgggtactactacgacccgaagaagcagttcgacatccgggaggtctacctggtgctggcccacatgatcaagtaccgcggcaacttcctcatggagggggacgtgaaggacagcgtcgtggaccccacctacctgaagcagtgcttcgacaacatcgacgtgatcctgatctccctcaacaacggcgaggacgacgagaacgaggacgacaagatcgaccccagcgagtgctgcttcaacgtcgacgagaagaaggcccggaagctggcgaacaacttccaggagaccaacaaggtgtccgacctggaggacgacgagcgcgacctcttcgggaagttcaacagcaaggacatccgcaagaagatcctgaagctgatcaacggcggctccggggtgaagctcaaggacttcctgcccaaggagatcctggtcgcccacgacggcgacgacgagtacggggacaagaagatcgacctcagctccgagaccctggaggacgacatcaacggctacagcctgccggagtcctacgtggagatcatcctcgaggccaagaagatctacgacttcaagacgctggcctacctgctccacggcaagagcctgctgtgcgacgcgatggtgaacgtctacgaggagcacaaggagcagctcgccgccctgaagcggctgtacaagaagtacgccaccaaggagcagtactacttcatgttccgcgactcccggatcctcgacggggacgacagcgacgacgaggaggacaaggaggagagcaacaaggaggagtccaaggacaagaagaagaaggccagctacgtgtcctacatcggctacaccaagaccaacagcaaggcgaagtacacgggggcccacatcacctccgagaagaacatcagcgccctgatcaagcagatcaaggacgacctgaagttcgacgacctcaagtccaaggtggacgaccccagccagcagaacgagctgtccgacgaggacaagctggacatccagtgcatcgaggaggccatcgagagcaacaccttcctcccccgccagaactcccggaacaacggcgccttcccctaccagctgaacctgaacgagatgcgcaccatcatcgagaaccagagcaagtactacccgttcctgaaggacaaggcgccctccttccccgacgggaagacggaggagtacaagatcgtcagcctcctgaagttcaagatcccctactacatcggcccgctgtcccagcccaacgactacgtgcgggacgacaagcgcgacaaccactgggtgcagttccggggcgagaacaaccaggggatcatcaacccctggaacttcagccagatcgtcgacctcgagggcaccgccgacaagttcatctccaacctgaccaactactgcacctacatcttcggggagaacacgctgcccaaggagagcctcatcttccaggcctacaaggtgctgaacgacctgaacaacctcaaggtgaacggctccctgatcagcaaggaggacaaggactacatcatccagaacgtctacctgaagaagaagaagatcaaggggaaggacatcgtgaacgccctcaagaacaagtacaagctgagcgacgaggacccgaccgtcaccaccaagggctccggcaagagcatcggggaggacgaggtggacctgacgatgttcaactccagcctctccagcttcatcgacatgtccgaccccaacgccttcggccccgagttctacaaggacagcaacaagttcgagctggcggagaaggtgatcgagctgatcaccatcgtcgaggacaaggacctcctgaaggagcgcctgaagaagctcgggctgtccgacaaccaggtgaactacctgttcaagcagaagtacagcggctgggcgcccctctcccggaagctgctggacgggatcaccatcgactgcgtgaacgagaacaccggcgaggcctacccggtcacgatcatcgacgtgatgcgcgacacgcccctcaacttcatggagatctacgagaccaaggagagccagttctccggcttcaaggagaaggtggccgagctgaacgacgagaagaagctgagccgggacgacctcatcgaggagtcctacgccagccccgccatgaagcgctccgtccggcagaccttcaaggtgatcgacgagctgaagaacaccctgaacatcgaccacttcgaccgcatcttcgtggaggccacccgggcccccggggaggccggcaagatggtcaagagccgcaagaagcagctccaggaggcgtacgacgccgccaaggacctggtggaccaggagagccgggacgacctgcagaagctccgcgacgacctggagaagcagaccgacgaccagctgcgccggaagaaggtgtacctctacttcatgcagctggggcgctccgtctacagcggcgagaagatcgacctgaacgagctcgacaagaactacgacatcgaccacatcatcccgcaggccaagctgaaggacgactccttcaacaacatggtgctggtggagcgggagctcaacaacaagaagcaggacgagtaccccatccccagcaccatcatctccgagcacggccgcaactggatccagaagctggccaagatccaggacaagaacaagcggagctacttcatgccgaaggacaaggcgaaccgcctgctccggcccgagtccaagcagctgacgagcgacgagctgaacgggttcatcaaccgccagctcaccctgaccaaccagtccgtcaaggccgtgtgcgacatcctgaagatgaccgagaagggcagcgagatcgtgtactccaaggccaacttcgtcagcgacttccggaagctctgcggggagctgcgcccctcctacgacgccttcgtgaaggtgcgggacatcaacgacttccaccacgccaacgacgcgtacctgaacatcgtcgtgggcaacgtgtactacgagaagttcaagaacttctacatcaacaaccgcatcgactacgacaacaacgggaagaaggacctcagcgtcctggcctccaagctgttcaccaagacgcaggccgacgacaagaccggcaacatctactgggaggcccggttccacaacgagaaggagaccgacagcaacggcaaggagcgcaccatcaaggtgcgggacgaggggacggagtccaccttcgacaagatcgagtactacatggagctcaacgaccccctggtgacccagatgcagtacaccctgagcggcaagcaggggttcttcaagaagatcacgctcaagaccaaggccaaggacaacgaggacaactccgacaagctgttcccgctgaagcagtacctccgcagcgacagcaacaaggtcatggacgtgaacaagtacggcgggtactccgacatgatcaccccctacttcatgctggtgcagagcgagggcaagaagggcaagcacatctactccctggagagcatccccaccatctacctcaagtccttcaagaagaaggaggaggacatcatcaactacctgagctgcaagaacaagctgaagaaccccgtcgtgatctccgacaagctcctgatgcggacgatcgtgaagatcccgtacttcaagaacgacagcaacctgtccctcgtcaagctggggaccagcggccgcaccgggaacaacatcatctacatcaacctgtccgagctcatcctgcccatcgagtggaagaactactaccggaagatcagcaacctgctcggcaccaacgtgtccagcacgaagcccaaggacctgtccaagttcaccgagcagatgaagaacgaccccaccagcaccctggtggacgggtccaacaaggtcgagcacgacaagaacaaccgcttcttcagctacctcatcaacaacgtgatcaacaagccgatcttcgagggcctgcccaagacgtcctgcagcttcatcaagctggagagcaagtacgacgagttctgctccctcaacaccctggagcaggcgaagatcatcgccaccatcatcaagctgctcagctgcaagtccgtgcagggctgcaagctgagcaacctgtccgggctccccagctccctgggcgccctgatcagcaacaaggccctgaccgaggggacgatcatctccaaggagagctcctgcggcctcaaggagaacatcatcttcgtcgtgcccaacgactga

SEQ ID NO: 2297 - RNA, 5067 nt, synthetic construct
  misc_feature 1..5067: note = Cas9 variant
  source 1..5067: mol_type = other RNA
atggagttcaagaaggtgctgggcctcgacatcgggaccaacagcatcggctgcgccctgctgtccctccccaagagcatccaggactacgggaagggcgggcgcctggagtggctgacctcccgggtcatcccgctcgacgccgactacatgaaggcgttcatcgacggcaagaacggcctgccccaggtgatcacgcccgccgggaagcgccggcagaagcgcggcagccggcgcctgaagcaccggtacaagctccgccggtcccgcctgatccgggtgttcaagaccctgaactggctccccgaggacttcccgctggacaaccccaagcgcatcaaggagaccatcagcaccgaggggaagttctccttccggatcagcgactacgtccccatctccgacgagagctaccgcgagttctaccgggagttcggctaccccgagaacgagatcgagcaggtgatcgaggagatcaacttccgccggaagacgaaggggaagaacaagaacccgatgatcaagctgctccccgaggactgggtggtctactacctgcgcaagaaggccctgatcaagcccaccaccaaggaggagctcatccggatcatctacctgttcaaccagcgccggggcttcaagtccagccgcaaggacctgaccgagacggccatcctcgactacgacgagttcgccaagcgcctggcggagaaggagaagtactccgccgagaactacgagaccaagttcgtgagcatcaccaaggtgaaggaggtcgtggagctgaagaccgacggccggaaggggaagaagcgcttcaaggtgatcctcgaggactcccggatcgagccctacgagatcgagcgcaaggagaagccggactgggagggcaaggagtacacgttcctggtcacccagaagctggagaaggggaagttcaagcagaacaagcccgacctccccaaggaggaggactgggccctgtgcaccaccgccctggacaaccggatgggcagcaagcaccccggcgagttcttcttcgacgagctcctgaaggcgttcaaggagaagcgcgggtacaagatccggcagtacccggtgaaccgctggcggtacaagaaggagctggagttcatctggacgaagcagtgccagctcaaccccgagctgaacaacctgaacatcaacaaggagatcctccgcaagctggccaccgtgctgtacccctcccagagcaagttcttcggccccaagatcaaggagttcgagaactccgacgtcctccacatcatcagcgaggacatcatctactaccagcgggacctgaagagccagaagtccctgatcagcgagtgccgctacgagaagcggaaggggatcgacggcgagatctacgggctcaagtgcatcccgaagtccagccccctgtaccaggagttccgcatctggcaggacatccacaacatcaaggtgatccggaaggagtccgaggtgaacggcaagaagaagatcaacatcgacgagacccagctgtacatcaacgagaacatcaaggagaagctcttcgagctgttcaacagcaaggactccctgagcgagaaggacatcctcgagctgatctccctgaacatcatcaacagcggcatcaagatctccaagaaggaggaggagaccacgcaccgcatcaacctgttcgccaaccggaaggagctcaaggggaacgagaccaagagccgctaccggaaggtcttcaagaagctgggcttcgacggggagtacatcctgaaccacccctccaagctcaaccgcctgtggcacagcgactactccaacgactacgccgacaaggagaagaccgagaagagcatcctgtccagcctcggctggaagaaccgcaacgggaagtgggagaagtccaagaactacgacgtgttcaacctgcccctggaggtggccaaggcgatcgccaacctcccgcccctgaagaaggagtacggcagctacagcgccctggccatccggaagatgctcgtcgtgatgcgcgacggcaagtactggcagcaccccgaccagatcgccaaggaccaggagaacacctccctgatgctgttcgacaagaacctcatccagctgacgaacaaccagcggaaggtgctgaacaagtacctcctgaccctggcggaggtccagaagcgcagcaccctcatcaagcagaagctgaacgagatcgagcacaacccctacaagctggagctcgtgtccgaccaggacctggagaagcaggtcctgaagagcttcctcgagaagaagaacgagtccgactacctgaaggggctgaagacctaccaggccggctacctcatctacgggaagcacagcgagaaggacgtgccgatcgtgaactcccccgacgagctgggcgagtacatccggaagaagctgcccaacaacagcctccgcaacccgatcgtcgagcaggtgatccgggagacgatcttcatcgtgcgcgacgtctggaagtccttcgggatcatcgacgagatccacatcgagctgggccgggagctgaagaacaacagcgaggagcgcaagaagacctccgagagccaggagaagaacttccaggagaaggagcgggcccgcaagctcctgaaggagctgctcaactccagcaacttcgagcactacgacgagaacggcaacaagatcttctccagcttcaccgtgaaccccaaccccgactcccccctggacatcgagaagttccggatctggaagaaccagagcgggctgaccgacgaggagctcaacaagaagctgaaggacgagaagatcccgacggagatcgaggtgaagaagtacatcctgtggctcacccagaagtgccgcagcccctacaccggcaagatcatccccctgtccaagctgttcgacagcaacgtctacgagatcgagcacatcatcccccggtccaagatgaagaacgacagcaccaacaacctcgtgatctgcgagctgggggtgaacaaggccaagggcgaccgcctggccgcgaacttcatctccgagagcaacggcaagtgcaagttcggggaggtcgagtacacgctcctgaagtacggcgactacctgcagtactgcaaggacaccttcaagtaccagaaggccaagtacaagaacctcctggccaccgagccgcccgaggacttcatcgagcggcagatcaacgacacccgctacatcgggcggaagctggccgagctcctgacccccgtggtgaaggactccaagaacatcatcttcacgatcggcagcatcacctccgagctgaagatcacctgggggctcaacggcgtctggaaggacatcctgcgcccccggttcaagcgcctggagagcatcatcaacaagaagctcatcttccaggacgaggacgacccgaacaagtaccacttcgacctgtccatcaacccccagctggacaaggagggcctcaagcgcctggaccaccggcaccacgccctggacgcgaccatcatcgccgccacgacccgcgagcacgtgcggtacctcaacagcctgaacgccgcggacaacgacgaggagaagcgcgagtacttcctgtccctctgcaaccacaagatccgggacttcaagctgccctgggagaacttcaccagcgaggtgaagtccaagctgctcagctgcgtcgtgtcctacaaggagagcaagcccatcctgtccgacccgttcaacaagtacctgaagtgggagtacaagaacgggaagtggcagaaggtgttcgccatccagatcaagaacgaccgctggaaggccgtccggcgcagcatgttcaaggagcccatcggcaccgtgtggatcaagaagatcaaggaggtgagcctcaaggaggccatcaagatccaggccatctgggaggaggtcaagaacgaccccgtgcggaagaagaaggagaagtacatctacgacgactacgcgcagaaggtgatcgccaagatcgtccaggagctggggctgtccagctccatgcgcaagcaggacgacgagaagctcaacaagttcatcaacgaggccaaggtgagcgccggcgtgaacaagaacctgaacacgaccaacaagaccatctacaacctggaggggcggttctacgagaagatcaaggtcgccgagtacgtgctctacaaggcgaagcgcatgcccctgaacaagaaggagtacatcgagaagctgtccctccagaagatgttcaacgacctgccgaacttcatcctggagaagagcatcctcgacaactaccccgagatcctgaaggagctggagtccgacaacaagtacatcatcgagccccacaagaagaacaaccccgtgaaccggctcctgctggagcacatcctggagtaccacaacaacccgaaggaggccttcagcaccgagggcctcgagaagctgaacaagaaggccatcaacaagatcggcaagcccatcaagtacatcacgcgcctggacggggacatcaacgaggaggagatcttccggggcgccgtcttcgagaccgacaaggggtccaacgtgtacttcgtgatgtacgagaacaaccagaccaaggaccgcgagttcctcaagcccaacccgagcatctccgtcctgaaggccatcgagcacaagaacaagatcgacttcttcgcgcccaaccggctgggcttcagccgcatcatcctctcccccggggacctggtgtacgtgcccaccaacgaccagtacgtcctgatcaaggacaacagctccaacgagacgatcatcaactgggacgacaacgagttcatcagcaaccggatctaccaggtgaagaagttcaccggcaactcctgctacttcctcaagaacgacatcgccagcctgatcctgtcctacagcgccagcaacggcgtgggggagttcggctcccagaacatcagcgagtactccgtcgacgacccgcccatccgcatcaaggacgtgtgcatcaagatccgcgtggaccggctcgggaacgtccgccccctgtga

SEQ ID NO: 2298 - RNA, 3924 nt, synthetic construct
  misc_feature 1..3924: note = Cpf1 variant
  source 1..3924: mol_type = other RNA
atgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaactga

SEQ ID NO: 2299 - RNA, 3903 nt, synthetic construct
  misc_feature 1..3903: note = Cpf1 variant
  source 1..3903: mol_type = other RNA
atgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaactga

SEQ ID NO: 2300 - RNA, 1341 nt, synthetic construct
  misc_feature 1..1341: note = Cpf1 variant
  source 1..1341: mol_type = other RNA
atgaagcccgacatcaaggaccgcgagtacatgtaccggctgatcatcggccagctgttctacgacgggcaccagcagatcgccgtgaacctcgccaacaccctgggctgcagcgcgccgcccccgccgccctccgacaagctgttccgcctcgtcaccatcgccaagcagttcgtggaggaccccgactacaaggccgaggagaacacgatgcccatgcagttcgagaccagctccgccgggctggacctccagtacgacgccgacgtggcggccaccagccccgagccctcccagtacgagaccatctacctgacggtccacaaggccccctgccgggccgcggccttcaacagcgacggctccctgatcgccaccgggagcgccgactgctccatcaagatcatggacgtggagcgcatcctcgcccgggagaaggagcaccgcgagatgaacgagaacggccccgacgcgcaccaccccgtgatccggaccctgtacgaccacgtcgacgtgcgccgggacttcggccgcttcagcgacaagatcctggacttccaggacgtgaacaccgtcatcttccacccgcgggacgccatcctcatctccgggagcaacgacaagacggtgaagctgttcgacttctccaagaccgccgtgaagcgcgccatgaagaccctgagcgaggtctaccccgtgcgggccctctcctgccaccccggcggggagttcctgctggtggcgaccgaccaccccacggtccgcctctacaacatcgagaccgcccaggcctacgccagcgccaacccggacgaccagcaccgggagtccgtgaccgacgtgcactacagcgagaacgcgcgcctgtacgtcaccgcctccaaggacggcgacgtgaaggtgtgggacggggtcagcagccggtgcgtggagacgttcaagcgcgcccacgacggctccagcatctgctccgccaagttcaccaagaacggcaagtacatcctgaccagcgggatggactccatcgtgaagctctgggagctgagcaccaaccggtgcctgatcgtctacacgggcgccggggcgaccggcgcccaggactaccccacctccgccagcttcaaccagaacgaggacttcgtcctcttccccgacgagaagtccggcagcatgtgctcctgggaggcccgcaacgcggaccggaagcgcctgctggccctcgggcacaccagcgcctgccgcacgttcgtgcactcccccagcatgccggccttcatgaccggctccgacgaccaccgggcccgcttctggtaccggaagcccaccaccaacgacaactga

SEQ ID NO: 2301 - RNA, 1293 nt, synthetic construct
  misc_feature 1..1293: note = Cpf1 variant
  source 1..1293: mol_type = other RNA
atgaagcccgacatcaaggaccgcgagtacatgtaccggctgatcatcggccagctgttctacgacgggcaccagcagatcgccgtgaccctcgccaacaccctgggctgcagcgcgccggccccgccgccctccgacaagctctaccgcctggtcacgatcgccaagcagttcgtggaggaccccgactacaaggccgaggagaagtccctgcccatgcagttcgagaccgtgagcaccgggctcgacctggagtacgacgccgacgtccagcccgtgagccccgagccctcccagtacgagaccatctacctgacggtgcacaaggcgccctgccgggccgccgccttcaacagcgacggctccctcgtcgcgaccgggagcgccgactgctccatcaagatcatggacgtggagcgcatcctggcccgggagaaggagcaccgcgagatgaacgagaacggccccgacgcccaccaccccgtgatccggaccctgtacgaccacgtcgacgacgtgaacaccgtcctcttccacccgcgcgacgccatcctgatcagcggctccaacgacaagacggtgaagctgttcgacttcagcaagaccgcggtgaagcgggccatgaagaccctctccgaggtgtaccccgtccgcgccctgagctgccaccccgggggcgagttcctgctcgtggccaccgaccaccccacggtgcggctgtacaacatcgagaccgcccaggcgtacgcctccgccaacccggacgaccagcaccgcgagagcgtcaccgacgtgcactactccgagaacgcccggctgtacgtgaccgccagcaaggacggggacgtcaagatctgggacggcgtgtccaaccgctgcgtggagacgttcaagcgggcgcacgacgggagcgccatctgcagcgccaagttcaccaagaacggcaagtacctcctgacctccggcatggacagcatcgtcaagctgtgggagctctccaccaaccgctgcctgatcgtgtacacgggggccggcgccaccggggcgcaggactacgccaccagcgcctccttcaaccacaacgaggactacgtcctgttccccgacgagaagtccggcagcatgtgcagctgggacgcccggaactccgaccgcaagcggctcctggcgctgggccacaccagcgcctgccgcacgttcgtgcactcccccagcatgcccgccttcatgaccgggtccgacgaccaccgggcccgcttctggtaccgcaagccggccaccaccgacaactga

SEQ ID NO: 2302 - RNA, 3690 nt, synthetic construct
  misc_feature 1..3690: note = Cpf1 variant
  source 1..3690: mol_type = other RNA
atggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagtga

SEQ ID NO: 2303 - RNA, 3903 nt, synthetic construct
  misc_feature 1..3903: note = Cpf1 variant
  source 1..3903: mol_type = other RNA
atgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcgacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcaggtcgcgcccaagaacctggacaacccgagcaagaaggagcaggacctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcctgaagtaccagaaccaggggaagaaggacctgctccaggcctccgcggaggaggacgtgaaggccatcaaggacctgctggaccagaccaacaacctgctccaccggctgaagatcttccacatcagccagtccgaggacaaggccaacatcctggacaaggacgagcacttctacctcgtgttcgaggagtgctacttcgagctggccaacatcgtgcccctgtacaacaagatccgcaactacatcacccagaagccctacagcgacgagaagttcaagctcaacttcgagaacagcaccctggccaacggctgggacaagaacaaggagccggacaacacggcgatcctgttcatcaaggacgacaagtactacctcggcgtgatgaacaagaagaacaacaagatcttcgacgacaaggccatcaaggagaacaagggggagggctacaagaagatcgtctacaagctgctgcccggggccaacaagatgctccccaaggtgttcttctccgccaagagcatcaagttctacaacccctccgaggacatcctgcggatccgcaaccacagcacccacaccaagaacggcaacccgcagaagggctacgagaagttcgagttcaacatcgaggactgccggaagttcatcgacttctacaaggagtccatcagcaagcaccccgagtggaaggacttcgggttccgcttctccgacacccagcggtacaacagcatcgacgagttctaccgcgaggtggagaaccagggctacaagctgacgttcgagaacatctccgagagctacatcgactccgtcgtgaaccaggggaagctctacctgttccagatctacaacaaggacttcagcgcgtactccaagggccggcccaacctgcacaccctctactggaaggccctgttcgacgagcgcaacctgcaggacgtcgtgtacaagctcaacggggaggccgagctgttctaccggaagcagagcatccccaagaagatcacccacccggccaaggaggccatcgcgaacaagaacaaggacaaccccaagaaggagtccgtgttcgagtacgacctgatcaaggacaagcgcttcaccgaggacaagttcttcttccactgccccatcacgatcaacttcaagagctccggcgccaacaagttcaacgacgagatcaacctcctgctgaaggagaaggccaacgacgtccacatcctcagcatcgaccggggcgagcgccacctggcctactacaccctggtggacgggaagggcaacatcatcaagcaggacaccttcaacatcatcgggaacgaccgcatgaagaccaactaccacgacaagctcgccgcgatcgagaaggaccgggacagcgcccgcaaggactggaagaagatcaacaacatcaaggagatgaaggagggctacctgtcccaggtggtccacgagatcgccaagctggtgatcgagcacaacgccatcgtggtcttcgaggacctcaacttcgggttcaagcggggccgcttcaaggtggagaagcaggtctaccagaagctggagaagatgctgatcgagaagctcaactacctggtgttcaaggacaacgagttcgacaagacgggcggggtgctgcgggcctaccagctcaccgcgcccttcgagaccttcaagaagatgggcaagcagaccgggatcatctactacgtgccggccggcttcaccagcaagatctgccccgtcacggggttcgtgaaccagctgtaccccaagtacgagtccgtgagcaagtcccaggagttcttcagcaagttcgacaagatctgctacaacctggacaagggctacttcgagttctccttcgactacaagaacttcggcgacaaggccgccaaggggaagtggaccatcgcgagcttcggctcccgcctcatcaacttccggaacagcgacaagaaccacaactgggacacccgcgaggtctaccccaccaaggagctggagaagctgctcaaggactactccatcgagtacgggcacggcgagtgcatcaaggccgccatctgcggcgagagcgacaagaagttcttcgccaagctgacgtccgtgctgaacaccatcctccagatgcggaacagcaagaccgggaccgagctggactacctgatctccccggtggccgacgtcaacggcaacttcttcgacagccgccaggcgcccaagaacatgccccaggacgccgacgccaacggggcctaccacatcggcctcaaggggctgatgctgctcgaccggatcaagaacaaccaggagggcaagaagctgaacctggtgatcaagaacgaggagtacttcgagttcgtgcagaaccgcaacaactga

SEQ ID NO: 2304 - RNA, 1071 nt, synthetic construct
  misc_feature 1..1071: note = Cpf1 variant
  source 1..1071: mol_type = other RNA
atgaagaccaactaccacgacaagctggccgccatcgagaaggaccgcgagagcgcgcggaaggactggaagaagatcaacaacatcaaggagatgaaggagggctacctctcccaggtggtccacgagatcgccaagctggtgatcgggtacaacgccatcgtggtcttcgaggacctgaacttcggcttcaagcgcgggcggttcaaggtggagaagcaggtctaccagaagctcgagaagatgctgatcgagaagctgaactacctcgtgttcaaggacaacgagttcgacaaggccggcggggtgctgcgcgcctaccagctgaccgcgcccttcgagacgttcaagaagatgggcaagcagaccggcatcatctactacgtgccggccgacttcaccagcaagatctgccccgtcaccgggttcgtgaaccagctctaccccaagtacgagtccgtgagcaagtcccaggagttcttcagcaagttcgacaagatctgctacaacctggacaagggctacttcgagttctccttcgactacaagaacttcggggacaaggccgccaagggcaagtggacgatcgcgagcttcgggtcccggctgatcaacttccgcaacagcgacaagaaccacaactgggacacccgggaggtctaccccaccaaggagctcgagaagctgctgaaggactactccatcgagtacggccacggcgagtgcatcaaggccgccatctacgccgagaacgacaagaagttcttcgccaagctcaccagcatcctgaactccatcctgcagatgcgcaacagcaagacggggaccgagctcgactacctgatctccccggtggcggacgtgaacggcaacttcttcgacagccggcacgcccccaagaacatgccccaggacgccgacgccaacggggcctaccacatcggcctgaagggcctcatgctgctgtaccgcatcaagaacaaccaggacgggaagaagctcaacctggtcatcaagaacgaggagtacttcgagttcgtgcagaaccggaacaagtccagcaagatctga

SEQ ID NO: 2305 - RNA, 3792 nt, synthetic construct
  misc_feature 1..3792: note = Cpf1 variant
  source 1..3792: mol_type = other RNA
atggaggactacagcggcttcgtgaacatctactccatccagaagaccctgcgcttcgagctcaagcccgtcgggaagaccctggagcacatcgagaagaagggcttcctgaagaaggacaagatccgggccgaggactacaaggccgtgaagaagatcatcgacaagtaccaccgcgcgtacatcgaggaggtgttcgacagcgtcctccaccagaagaagaagaaggacaagacgcggttctccacccagttcatcaaggagatcaaggagttcagcgagctgtactacaagaccgagaagaacatcccggacaaggagcgcctggaggccctctccgagaagctgcggaagatgctggtgggggccttcaagggcgagttcagcgaggaggtggccgagaagtacaagaacctcttctccaaggagctgatccgcaacgagatcgagaagttctgcgagaccgacgaggagcggaagcaggtcagcaacttcaagtccttcacgacctacttcaccgggttccacagcaaccgccagaacatctactccgacgagaagaagtccaccgccatcggctaccggatcatccaccagaacctgcccaagttcctcgacaacctgaagatcatcgagagcatccagcgccggttcaaggacttcccctggagcgacctgaagaagaacctcaagaagatcgacaagaacatcaagctgacggagtacttctccatcgacggcttcgtgaacgtgctgaaccagaaggggatcgacgcgtacaacaccatcctcggcggcaagagcgaggagtccggggagaagatccaggggctgaacgagtacatcaacctgtaccgccagaagaacaacatcgaccggaagaacctccccaacgtcaagatcctgttcaagcagatcctgggcgaccgcgagaccaagagcttcatcccggaggccttccccgacgaccagtccgtgctcaacagcatcaccgagttcgccaagtacctgaagctggacaagaagaagaagtccatcatcgccgagctcaagaagttcctgagcagcttcaaccggtacgagctggacggcatctacctcgcgaacgacaactccctggccagcatctccacgttcctgttcgacgactggagcttcatcaagaagtccgtgagcttcaagtacgacgagtccgtcggggaccccaagaagaagatcaagagccccctcaagtacgagaaggagaaggagaagtggctgaagcagaagtactacaccatctccttcctgaacgacgccatcgagagctactccaagagccaggacgagaagcgcgtgaagatccggctcgaggcctacttcgccgagttcaagtccaaggacgacgcgaagaagcagttcgacctgctggagcgcatcgaggaggcctacgccatcgtggagccgctcctgggcgccgagtacccccgggaccgcaacctgaaggccgacaagaaggaggtcgggaagatcaaggacttcctcgacagcatcaagtccctgcagttcttcctgaagcccctcctgagcgcggagatcttcgacgagaaggacctgggcttctacaaccagctcgagggctactacgaggagatcgactccatcgggcacctgtacaacaaggtgcggaactacctgaccggcaagatctacagcaaggagaagttcaagctgaacttcgagaacagcaccctcctgaaggggtgggacgagaaccgcgaggtggccaacctgtgcgtcatcttccgcgaggaccagaagtactacctcggcgtgatggacaaggagaacaacacgatcctgtccgacatccccaaggtgaagccgaacgagctgttctacgagaagatggtctacaagctcatccccacgccccacatgcagctgccccggatcatcttcagctccgacaacctgagcatctacaacccgtccaagagcatcctcaagatccgcgaggccaagtccttcaaggaggggaagaacttcaagctgaaggactgccacaagttcatcgacttctacaaggagagcatctccaagaacgaggactggagccggttcgacttcaagttctccaagaccagctcctacgagaacatcagcgagttctaccgcgaggtggagcggcagggctacaacctggacttcaagaaggtgtccaagttctacatcgacagcctcgtcgaggacggcaagctgtacctgttccagatctacaacaaggacttctccatcttcagcaaggggaagcccaacctccacaccatctacttccgcagcctgttctccaaggagaacctgaaggacgtgtgcctcaagctgaacggcgaggccgagatgttcttccggaagaagtccatcaactacgacgagaagaagaagcgcgaggggcaccaccccgagctgttcgagaagctcaagtaccccatcctgaaggacaagcggtacagcgaggacaagttccagttccacctcccgatcagcctcaacttcaagtccaaggagcgcctgaacttcaacctgaaggtcaacgagttcctcaagcggaacaaggacatcaacatcatcggcatcgaccgcggggagcggaacctgctgtacctcgtgatgatcaaccagaagggcgagatcctgaagcagaccctgctcgacagcatgcagtccggcaaggggcgccccgagatcaactacaaggagaagctgcaggagaaggagatcgagcgggacaaggcccgcaagagctggggcaccgtggagaacatcaaggagctgaaggaggggtacctctccatcgtcatccaccagatcagcaagctgatggtggagaacaacgcgatcgtggtcctggaggacctcaacatcggcttcaagcgggggcgccagaaggtggagcgccaggtgtaccagaagttcgagaagatgctgatcgacaagctgaacttcctcgtcttcaaggagaacaagcccaccgagcccggcggcgtgctgaaggcctaccagctgaccgacgagttccagtccttcgagaagctcagcaagcagacggggttcctgttctacgtgccgtcctggaacaccagcaagatcgacccccggaccggcttcatcgacttcctgcaccccgcctacgagaacatcgagaaggccaagcagtggatcaacaagttcgactccatccgcttcaacagcaagatggactggttcgagttcaccgccgacacgcggaagttctccgagaacctcatgctggggaagaaccgcgtctgggtgatctgcaccaccaacgtggagcggtacttcaccagcaagacggcgaactccagcatccagtacaacagcatccagatcaccgagaagctgaaggagctgttcgtcgacatccccttctccaacggccaggacctgaagccggagatcctgcgcaagaacgacgccgtgttcttcaagagcctcctgttctacatcaagaccaccctgtccctccggcagaacaacggcaagaagggggaggaggagaaggacttcatcctgagccccgtggtcgactccaagggccgcttcttcaacagcctggaggcctccgacgacgagcccaaggacgccgacgcgaacggggcctaccacatcgccctcaagggcctgatgaacctgctcgtgctgaacgagacgaaggaggagaacctgagccggccgaagtggaagatcaagaacaaggactggctcgagttcgtgtgggagcgcaaccggtga

SEQ ID NO: 2306 - RNA, 2820 nt, synthetic construct
  misc_feature 1..2820: note = Cpf1 variant
  source 1..2820: mol_type = other RNA
atgaacctgtacagcaacctcaccaacaagtactccctgagcaagaccctgcgcttcgagctcatcccccagggcgagacgctggagaacatcaaggcccgggggctgatcctcgacgacgagaagcgcgccaaggactacaagaaggcgaagcagatcatcgacaagtaccaccagttcttcatcgaggagatcctgtccagcgtgtgcatctccgaggacctgctccagaactacagcgacgtctacttcaagctgaagaagtccgacgacgacaacctgcagaaggacttcaagagcgccaaggacaccatcaagaagcacatctcccggtacatcaacgacagcgagaagttcaagaacctcttcaaccagaacctgatcgacgccaagaagggccaggagtccgacctgatcctctggctgaagcagagcaaggacaacgggatcgagctgttcaaggccaactccgacatcaccgacatcgacgaggccctcgagatcatcaagagcttcaagggctggaccacgtacttcaaggggttccacgagaaccgcaagaacgtgtactccagcgacgacatcccgacctccatcatctaccggatcgtggacgacaacctgcccaagttcatcgagaacaaggcgaagtacgagaacctgaaggacaaggcccccgaggccatcaactacgagcagatcaagaaggacctcgccgaggagctgaccttcgacatcgactacaagaccagcgaggtcaaccagcgcgtgttctccctggacgaggtgttcgagatcgcgaacttcaacaactacctcaaccagagcggcatcacgaagttcaacaccatcatcggcgggaagttcgtcaacggcgagaacaccaagcggaaggggatcaacgagtacatcaacctgtacagccagcagatcaacgacaagaccctgaagaagtacaagatgtccgtgctgttcaagcagatcctgagcgacacggagtccaagagcttcgtgatcgacaagctggaggacgactccgacgtcgtgaccaccatgcagagcttctacgagcagatcgccgccttcaagaccctcgaggagaagtccatcaaggagacgctgagcctcctcttcgacgacctgaaggcccagaagctggacctctccaagatctacttcaagaacgacaagagcctgaccgacctgtcccagcaggtcttcgacgactacagcgtgatcggcaccgccgtgctcgagtacatcacccagcaggtcgcgcccaagaacctggacaacccgtccaagaaggagcaggacctgatcgccaagaagacggagaaggccaagtacctcagcctggagaccatcaagctggccctcgaggagttcaacaagtaccgcgacatcgacaagcagtgccggttcgaggagatcttcgcctccttcgcggacatccccgtgctgttcgacgagatcgcccagaacaagaacaacctggcccagatcagcatcaagtaccagaaccaggggaagaaggacctcctgcagacctccgccgaggtggacgtgaaggccatcaaggacctgctggaccagaccaacaacctcctgcacaagctgaagatcttccacatcacgcagagcgaggacaaggcgaacatcctcgacaaggacgagcacttctacctggtcttcgacgagtgctacttcgagctggccaacatcgtggccctctacaacaagatccgcaactacatcacccagaagccctactccgacgagaagttcaagctgaacttcgagaacagcaccctggccaacggctgggacaagaacaaggagcccgacaacaccgccatcctcttcatcaaggacgacaagtactacctgggcgtgatgaacaagaagaacaacaagatcttcgacgacaaggcgatcaaggagaacaagggggagggctacaagaaggtcgtgtacaagctgctcccgggggccaacaagatgctgcccaaggtgttcttcagcgccaagtccatcaacttctacaaccccagcgaggacatcctgcggatccgcaaccactccacgcacaccaagaacggcagcccccagaagggctacgagaagctcgagttcaacatcgaggactgccggaagttcatcgacttctacaagcactccatcagccgccacccggagtggaaggacttcgggttccggttctccgacaccaagaagtacaacagcatcgacgagttctaccgcgaggtcgagaaccagggctacaagctgaccttcgagaacatctccgagagctacatcgactccctggtggacgaggggaagctctacctgttccagatctacaacaaggacttcagcgtctactccaagggcaagcccaacctgcacacgctctactggaaggccctgttcgacgagcggaacctgcaggacgtggtgtacaagctcaacggggaggcggagctgttctaccgcaagcagagcatccccaagaagatcacccaccccgccaaggaggccatcgccaacaagaacaaggacaacccgaagaaggagtccatcttcgagtacgacctgatcaaggacaagcggttcaccgaggacaagttcttcttccactgccccatcaccatcaacttcaagagctccggcgccaacaagttcaacgacgagatcaacctcctgctgaaggagaaggcgaacgacgtccacatcctcagcatcgaccgcggcgagcggcacctggcctactacacgctggtggacgggaagggcaacatcatctgcaagaactga

SEQ ID NO: 2307 - RNA, 3795 nt, synthetic construct
  misc_feature 1..3795: note = Cpf1 variant
  source 1..3795: mol_type = other RNA
atgctgttccaggagttcacccacctctaccccctgagcaagaccgtgcgcttcgagctgaagccgatcggcaagacgctcgagcacatccacgccaaggacttcctgtcccaggacgagaccatggccgacatgtaccagaaggtcaaggcgatcctggacgactaccaccgggacttcatcgccgacatgatgagcggggtggtgctcaccaagctggccgagttctacgaggtctacctggccctccgcaagacccccaaggacgactccctgcagaagcagctgacggagatccagaccgccctccggaaggagatcgtgaagcccatcggcagcgggggcaagtacaaggcggggtacgaccgcctgttcggcgccaagctgttcaaggacggcaaggagctcggggacctggccaagttcgtgatcacccaggagggcgagtccagccccaagctggcccacatcgcgcacttcgagaagttctccacctacttcacggggttccacgacaaccggaagaacatgtacagcgacgaggacaagcacaccgccatcgcctaccgcctcatccacgagaacctgccgcggttcatcgacaacctgcagatcctcgccaccatcaagcagaagcactccgccctgtacgaccagatcgtcaacgagctgaacgcgaacggcctcgacgtgagcctggcctcccacctggacgggtaccacaagctcctgacccaggagggcatcacggcctacaacaccctgctcggcgggatcagcggcgaggccgggtcccgcaagatccagggcatcaacgagctgatcaacatccaccacaaccagcactgccagaagtccgagcggatcgccaagctgcgccccctccacaagcagatcctgagcgacggcatgggggtgagcttcctgccctccaagttcgcggacgacagcgaggtctgccaggccgtgaacgagttctaccggcactacgcccacgtgttcgccaaggtccagtccctcttcgaccgcttcgacgactaccggaaggacggcatctacgtggagcacaagaacctgaacgagctgagcaagcaggccttcggggacttcgcgctcctgggccgcgtgctggacgggtactacgtcgacgtggtgaaccccgagttcaacgagcggttcgccaaggccaagaccgacaacgccaaggagaagctcaccaaggagaaggacaagttcatcaagggcgtccacagcctggcctccctggagcaggcgatcgagcactacatcgccggccacgacgacgagagcgtgcaggccgggaagctcggccagtacttcaagcacgggctggccggcgtggacaacccgatccagaagatccacaactcccacagcacgatcaaggggttcctggagcgcgagcggcccgcgggcgagcgcgccctccccaagatcaagtccgacaagagccccgagatgacccagctgcggcagctgaaggagctgctcgacaacgccctgaacgtcgtgcacttcgccaagctgctcaccaccaagacgaccctggacaaccaggacggcaacttctacggggagttcggcgccctgtacgacgagctcgcgaagatcgccaccctgtacaacaaggtgcgcgactacctgtcccagaagccgttcagcaccgagaagtacaagctcaacttcgggaaccccacgctgctgaacggctgggacctcaacaaggagaaggacaacttcggggtcatcctgcagaaggacggctgctactacctggccctcctggacaaggcccacaagaaggtgttcgacaacgcccccaacgcgggcaagtccgtctaccagaagatggtgtacaagctgctccccgggccgaacaagatgctgcccaaggtgttcttcgccaagagcaacctggactactacaacccctccgccgagctcctggacaagtacgcccagggcacccacaagaaggggaacaacttcaacctgaaggactgccacgccctcatcgacttcttcaaggcgagcatcaacaagcaccccgagtggcagcacttcggcttcgagttctccccgaccagctcctaccaggacctgagcgacttctaccgggaggtcgagccccagggctaccaggtgaagttcgtggacatcaacgccgagtacatcgacgagctggtcgagcaggggcagctctacctgttccagatctacaacaaggacttctcccccaaggcccacggcaagcccaacctgcacaccctctacttcaaggccctgttcagcgagaacaacctggcgaacccgatctacaagctcaacggggaggccgagatcttctaccgcaaggcctccctggacatgaacgagacgaccatccaccgcgccggcgaggtgctggagaacaagaaccccgacaaccccaagaagcggcagttcgtgtacgacatcatcaaggacaagcgctacacccaggacaagttcatgctccacgtccccatcaccatgaacttcggggtgcagggcatgacgatcaaggagttcaacaagaaggtgaaccagagcatccagcagtacaacgacgtcaacgtgatcggcatcgaccgcggggagcggcacctcctgtacctgaccgtgatcaacagcaagggcgagatcctggagcagcggtccctgaacgacatcatcaccaccagcgccaacgggacgcagatgaccaccccgtaccacaagatcctcgacaagcgcgagatcgagcggctgaacgcgcgcgtcggctggggcgagatcgagaccatcaaggagctgaagtccgggtacctcagccacgtggtgcaccagatctcccagctgatgctgaagtacaacgccatcgtcgtgctcgaggacctgaacttcggcttcaagcgggggcgcttcaaggtggagaagcagatctaccagaacttcgagaacgccctgatcaagaagctcaaccacctggccctgaaggacaaggccgacgacgagatcggcagctacaagaacgcgctccagctgaccaacaacttcacggacctgaagtccatcgggaagcagaccggcttcctcttctacgtccccgcctggaacaccagcaagatcgaccccgccaccgggttcgtggacctgctgaagccgcggtacgagaacatcgcccagtcccaggccttcttcggcaagttcgacaagatcttctacaacgcggacaagggctacttcgagttctacgtggactacgccaagttcacggacaaggccaagaacagccgccagacctgggtcatctgctcccacggggacaagcggtacgtgtacgacaagaccgccaaccagaacaagggcgcgaccatcgggatcaacgtgaacgacgagctcaagagcctgttcgcccgctaccacatcaacgacaagcagcccaacctggtcatggacatctgccagaacaacgacaaggagttccacaagtccctcatgtacctgctgaaggccctcctggccctgcggtacagcaacgcctccagcgacgaggacttcatcctctcccccgtggcggacgacaagggcgtgttcttcaacagcgccctggccgacgacacgcagccccagaacgccgacgccaacggggcgtaccacatcgccctgaagggcctctggctgctgaacgagctcaagaacagcaacgacctggacaagatcaagctggccatcgacaaccagacctggctcaacttcgcccagaaccgctga

SEQ ID NO: 2308 - RNA, 3903 nt, synthetic construct; identical to SEQ ID NO: 2303
  misc_feature 1..3903: note = Cpf1 variant
  source 1..3903: mol_type = other RNA

SEQ ID NO: 2309 - RNA, 3756 nt, synthetic construct
  misc_feature 1..3756: note = Cpf1 variant
  source 1..3756: mol_type = other RNA
atgaaccacatgaagcagttcaccaaccagttcagcctgtccaagaccctccgcttcgagctgatcccccagggcaagacgaaggagttcatcgagatcaacgggctgatcgagaaggacaacgagcgggccgtgagctacaagaaggtcaagaagatcatcgacgagtaccacaagtacttcatcgagatggtgctctgcgacttcaagctgcacggcctggagacctacgagaccatcttcaacaagaaggagaaggacgacaccgacaagaaggagttcgacaacatccgcaactccctccggaagcagatcgccgacgcgttcgccaagaacccgaacgacgagatcaaggagcgcttcaagaacctgttcgccaaggagctgatcaagcaggacctcctgaacttcgtggacgacgagcagaaggagctggtcaacgagttcaaggacttcacgacctacttcaccgggttccaccagaaccggcgcaacatgtacgtggccgacgagaaggccaccgcgatcgcctaccggctcgtgaacgagaacctgcccaagttcatcgacaacctgaagatctacgagaagatcaagaaggacgcccccgagctcatcagcgacctgaacaagacgctggtcgagatggaggagatcgtgcagggcaagaccctcgacgagatcttctccctgagcttcttcaaccagaccctgacccagacggggatcgagctctacaacatcgtgatcggcggccgcaccgccgacgaggggaagaccaagatcaagggcctgaacgagtacatcaacaccgactacaaccagaagcagacggacaagaagaagaagcaggcgaagttcaagcagctgtacaagcagatcctctccgaccggcacagcgtctccttcgtggccgagaccttcgagaccgacgcccagctgctggagaacatcgagcagttctacagctccgtgctctgcaactacgaggacgacgggcacaccacgaacatcttcgaggccatcaagaacctgatcatcggcctgaagaccttcgacctcagcaagatctacctgcgcaacgacacctccctgaccgacatcagccagaagctgttcggggactggtccatcatcagctccgccctgaacgactactacgagaagcagaaccccatcagctccaaggagaagcaggagaagtacgacgagcggaaggcgaagtggctgaagcaggacttcaacatcgagacgatccagaccgccctcaacgagtgcgacagcgagatcatcaaggagaagaacaacaagaacatcgtcagcgagtacttcgccaagctgggcctggacaaggacaacaagatcgacctcctgcagaagatccaccacaactacgtggtgatcaaggacctgctcaacgagccgtaccccgagaacatcaagctgggcaaccagaaggagcaggtctcccagatcaaggacttcctggacagcatcctcaacctgatccacttcctgaagcccctctccctgaaggacaaggacaaggagaaggacgagctgttctacagcctgttcaccgccctcttcgagcacctgtcccagaccatcagcatctacaacaaggtgcgcaactacctgacgcagaaggcctactccaccgagaagatcaagctcaacttcgagaacagcaccctgctgaacgggtgggacgtgaacaaggagcccgtcaacacctccgtgatcttccggaagaacggcctcttctacctggggatcatgagcaagtccaacaaccgcatcttcgagcggaacgtgccggtctgcaagaacgaggagacggcgttcgagaagatgaactacaagctgctccccggcgccaacaagatgctgcccaaggtgttcctgagcgccaagggcatcgagtccttccagcccagcgccgagatccagtccaagtaccagaaggagacccacaagaagggggacgccttcgtgcgcaaggacatggagaacctcatcgacttcttcaagcagagcatcgcgaagcacaccgactggaagcacttcaaccaccagttctccaagaccgagacgtacaacgacctgagcgagttctacaaggaggtcgagaagcagggctacaagctgaccttcaccaagctcgacgagacctacatcaaccagctggtggacgaggggaagctgtacctcttccagatctacaacaaggacttctccccgttcagcaagggcaagcccaacatgcacaccctgtactggaagatgctgttcgacgagcagaacctccagaacgtcgtgtacaagctgaacggggaggccgaggtgttcttccggcagagctccatcaagcagacggaccgcatcatccacaaggccaaccaggccatcgacaacaagaaccccctgaacaacaagaagcagagctccttcaactacgacctcatcaaggacaagcggttcaccctggacaagttccagttccacgtccccatcaccctgaacttcaaggccgagggcaacgagtacctcaacaccaaggtgaacgagtacctcaagagcaactccgacgtgaagatcatcggcctggaccgcggggagcggcacctcatctacctgacgctgatcaaccagaagggcgagctcctgaagcagcagagcctgaacgtcatcgcgacctcccaggagcacgagaccgactacaagaacctcctggtgaacaaggagaacgagcgcgccaacgcccgccaggactggaagaccatcgagacgatcaaggagctgaaggaggggtacctcagccaggtggtccaccagatcgccaccatgatggtggacgagaacgcgatcgtggtcatggaggacctgaacgccggcttcatgcgggggcgccagaaggtggagcgccaggtgtaccagaagctggagaagatgctcatcgagaagctgaactacctggtcttcaagaacaacgacgtgaacgagaccgccggcgtgctcaacgccctgcagctgaccaacaagttcgagtccttcgagaagatgggcaagcagagcgggttcctcttctacgtcccggcctggaacacgtccaagatcgaccccgcgaccggcttcgtggacttcctgaagcccaagtacgagagcgtggagaaggccaagctgttcttcgagaagttcgagtccatcaagttcaacgccgacaagaactacttcgagttcgagttcgactacaagaagttcaccgagaaggccgaggggagccagaccaagtggacggtctgcacccactccgacgtgcggtaccggtacaacccccagaccaaggccagcgacgaggtgaacgtcaccaacgagctcaagctgatcttcgacaagttcaagatcgagtacaagaacggcaagaacctgaagacggagctcctgctgcaggacgacaagcagctgttctccaagctcctgcactacctcgcgctgaccctgatgctccgccagagcaagagcgggaccgacatcgacttcatcctgtccccggtggccaagaacggcgtgttctacgacagccggaacgccatgcccaacctgcccaaggacgccgacgccaacggcgcgttccacatcgccctcaaggggctgtggtgcgtccagcagatcaagaaggccgacgacctgaagaagatcaagctcgccatctccaacaaggagtggctgagcttcgtgcagaacctgaagtga

SEQ ID NO: 2310 - RNA, 4173 nt, synthetic construct
  misc_feature 1..4173: note = Cpf1 variant
  source 1..4173: mol_type = other RNA
atgatcgacaacaccaaggagaagaaggagggcagcgtgttcgacgggttcacccgcaagtaccagctgtccaagacgctccggttcgagctgcgccccatcctgaacaccccgaagatgctcgacgacgagcaggtcatcaagaacgacgagacccggcgcaagaagtacgaggccgtgaagccctggttcgaccagctgcaccgggagttcatcgaggacgccctcaagagcttcaagttcaagaacctcgcgatctaccaggacaccttccagacgtggcagaaggaccgcaagtccaagcagaagaaggacaccctggtgaagatcgaggtcggcctgcgggaggagatcgtgcgccggttcgaggaggtggccaacatctgggtccgcagcgagcagtacaagctcctggggatcaagaaggagggcctggggatgctgttcgaggccggcgtgttccggctgctgaaggagcgcttcaagaacgagaaggacaccaccgtggacggcaacaacatcttcgacgagtggacgcggtggaccgggtacttcaagaagttcttcgagacccgcaagaacttctacaagtccgacgacaccagcacggccatcgcctaccgggtcatcaaccagaacctccgccggttctgcgagaacatccagatcttcgagaagatctccgagaagatcgagttcagcgaggtggagaagtccttcgacatcagctgcgcgggcatcttctccctggcctactacaacgcctgcctgctccagggcgggatcgacacctacaacaagatcatcgggggcgaggtggacgagaaggacaagaagatccccggcatcaacgagctgatcaacaagtaccgccaggacaacagcggggagaagatccccttcctgaagcagctcgacaagcagatccactccgccaaggaggcgttcatcgagagcatcgagaccaacaaggagctggtcggcaagctgaagaccttctacgagaacgccgaggtgaagatccagtccttccggaacctcatcgccgacatcgtgacggactacagcgggtacgacatcgacaagatctacctgaccaaggaggccgtctcccacaacgccagccgctggttcgcgtccttcgagagcttcgagcgggacctgttcgccgtggtggccgagaagcagaacaagctcgtctacgagctgctgcgcacccacaagaacgacagcaagatctccgacaaggacggcaagttcagcttcccggacttcatcaagtgctcccacatcaagcgcgccctcgagaagcaggagggccggatctggaagggggagtactacgaggacatcgtggacttcgagaagatcaaggacgtgttcacccagttcctgtgcgtcttcaagttcgagctggagcagcagttcttccgcaagacgaccagcgcccagaccggcgagcagaccaagatcgggtacgagatcttcgtgacgaagatcaacgagctcatcacccgggagaaccccgtgatcgacctggaggagaagatcgcgatcaagaacttcgccgacgccaccctgctcatctaccagatcgccaagtacttcgccgtcgagaagcgccggggctggctggacaactacgacctggacgaccgcttctacaagtccagcgacatcgggtacctcaacttctaccgggacgcgttcgagcagatcgtgcgcccctacaacctgttccggaactacctgaccaagaagccctacaacacgaacaagtgggtcctctccttcgagaacccgaccctggccgacggctgggacaagaacaaggagaagaccaacgccgccgtgatcctgcgcaaggacggccggtactacctcgggatcatcaaggaggactgcaagagcctgttcgccgaccgctactccaaggagatgagcgagggcatcgagtccgggagcttccagaagatggcgtacaagttcttccccgaggcctccaagatgatccccaagtgcagcacccagacgaagaacgtgaaggagcacttccggaagtccagctccgactacaacctgttccacgagaaggactacaagatcagcgtcgccatcaccaagaacatctacgagctcaacaacgtgttctaccgcaaggacaacatcgaggagtccttcgtgcccaagaacgacttcgagaagaagctgggcgtcaagaagttccagcggcagtacctggagatcagccgcgacaacaacgggtacaagcaggccctggcgcagtggatcgagttctgcatccggttcctcaaggcctacaagagcaccaccatcttcgactactcccgcctgcgggaggccaaggagtacgagagcctggacgccttctaccaggacatcaacgccctcacgtacaacatctccttcgtgccgatcagcgagcagtacatcaaggagaagaacgacaacggcgagctgttcctgttcgagatctacaacaaggactggtccctcggccccatggacaagaaccgcaagcgcaccaagaacctgcacaccctgtacttcgagcagctgttcagcaaggagaacgagcaggagaacttcctcttccagctgaacggggaggcggagctgttcttccggcccaagaccgaggagaagcgcctcggctacaaggtgtgggacgccggggagaagaagtgggtcaaggccaaggagaaggaggacggcgccgtgatcgaccggaagcgctacgccaaggacatcatcctgttccactgccccatcaccctcaaccgggtgtccgagagcaagacgaagcgcgagatggacgtcgagatccgggaggtgctgtccagcaccccgggggtgcacatcatcggcgtcgaccgcggcgagaagcacctggcgtactactccgtgatcgaccagaacgggaagatcatcgagaccgacaccctcaacagcatcggcaaggacgggcggggcaagcccgtggagtacgcctccaagctggagaagcgcgcccaggagcgggaggccagccgccgggactgggaggaggtcgaggccatcaaggacctgaagaagggctacatctcccaggtgatccgcaacctcgcggacctgatcatcaagcacaacgccatcatcgtgttcgaggacctgaacatgcggttcaagcagatccgcgggggcatcgagaagtccgcctaccagcagctcgagcgggccctgatcgacaagctgagcttcctcgtcaagaagggggaggaggaccccaagcagacgggccacatcctgcgcgcgtaccagctggccgcccccgtgatcgccttcaaggacatggggaagcagaccggcctcatcttctacacccaggccggctacaccagcaagacgtgcccggagtgcgggtaccggcgcaacatcaagtgcctgttcgagaacatcgagcaggcgaagaccctgatcgagaacctcgagagcatcaactacaacaagaaggaggacgtgttccagatctcctacagcctggagaagctgtccagcaaggaccagaagaaggagaagaaggtctccaacgagctctacgccaagaccctgaagaaggacatcttcatcctgaccacgaagaacgccctccggtacaagtggtacgaccgctacagcgagaaggccaaggtggccaagcgcggcatcgacgagtacaagggggaggtgaacgagtccgagaccaagaagggcgtcgtgaaggagttcaacctgaccgagtacctgaaggggctcctgaagacctacgagatcgactacgagcacggcggcatccgggagcagatcctgagcgtggcgcgcgggcgggagttctacaaggacttcctctacgccctgttcctgctcacggagacccgccactccatcagcggccggaacaccgactacatccagtgccccgagtgcgagttcgactcccgcaaggggttcaaggacatcaaggagttcaacggcgacgccaacggggcctacaacatcgcccggaagggcatcatgatcctggagaagatcaagcagttcaagaaggacaacgacggcaacctggagaagatggggtggggcgacctcagcatctccatcgaggagtgggacaagttcacccagaaggagtga

SEQ ID NO: 2311 - RNA, 4026 nt, synthetic construct
  misc_feature 1..4026: note = Cpf1 variant
  source 1..4026: mol_type = other RNA
atgaacgccgagaagaagtgcgccttcaacgagttcaccaacctgtacgagctcagcaagaccctgaagttcgagctgaagcccgtgggcaagacgaaggagatcatcaagaacttccgcgaggagctcgagaagaacaacccgatccagctggacaaggagatctccatcgcgaagcaggagatcaagaaggacctggacatcctccaccgggagttcgtccgccagagcttcgagctggccttcaaggagaacaagatcaactacgagatcttcttcgagatctaccggaacttcaagaagttctccaagaacaagaagtccgacgagtacatcgccgccatcaagaacctgaaggaggagaagatcaagctcgtgaagaagatcgccgactacttcgtgaagatggaccaggagtggcgcaagtactaccccagcgagaagaagtccttcctgctgatgagcaacggggtcatcaacctcctgatcgacatcaacaaggaccggatggactacagcttcatccccaaggaggtgtgcgagaagatcaagggcaaggggaagatcgagctgtacgagaagttcaacaagcacttcggctacctctccaagtacaacaccgcgcgcgagaacttctacagcgacgacgtgaagaactccgccagcgtcgcctaccgggccatctgcgagaacctggagaagttctgcgacaacaagatcaaggtggaggcggacaacttccccaaggagatcaaggagaagttcctggagtacttcaacaagatcaccgacctctccttctacaaccgctgcctgagccagaacgggatcgaggagtaccacaagttcaaggacgagatcaaccggtccatcaacgagctgtacccgaacaacagcaagaacaagccccagaacatcccctacctctccaagctggacaagcagatcctgagcgagaaggacaagcagtcctggatcgaggagggcttcatcgacgagaacaacttcatcttcgagttcgagaagttcatcaagatgaacgacaagtacatccccagcgagaagaagctgttcaacgagttcttcatcttccagaacaacgacgaggtgctccagaagctgttcctcctgaagaagaccatcaacaacttcgccaacatctacctggacgacccgaagaacctcatggacctgatgcccagcaagggcacgaagaagcgcgactacctgtccctcctggagatcaaggaggccctgaacagctacgccgagaaccagaacatcggggagacccagatcttcaagatcaagtacgacgacgtcatcgacaagaccaagacccccttcgagtgcttcatgaagatctggaagtacgagtacgacctcctgtacaacgagggcgacgggaagaagaacatcgaggagggctgggagaagatctgcgagaagctgcagaacaagaaggacgagttcacgggggactacggcaagtacaagaaggagatcaaggactactgcgagatggccctctccctgagccagcggatcaagcacctggacatccgcatcaagaagcgggacggctccgaggacgcggacaacaacctcttcgagggggtggagaagctggacgagttctacgaccgcctgttcgagatcgtggacgagcacaacgcctaccagtaccaccacgagttccaggccttcctcaccaagaagccctacaagaccgacaagttcaagctgagcttcgacaacccgcagctgctcaagggctgggacctgaacaaggagcccgactacttcggggccctgctggtcaagaacgagaagtacttcctcgccgtgttccacaagcagtacgcgaacgagatcttccggcagaagaacaagaactccaccgtgaagatcaaggaggcctacgacgtcttcaacggcaactactacaagaaggtggagctgaagcagatccccaagctgttcatgaacctcccccgcatctgcttcgccaagagcaaccaggaggagttcggcctgacgatcgagctggagaagatcaagtccgagttcgacaagttccagaagctcaagaaggagcggcaggacaacaacctgaagttcgaccaggagaagttcatcaagctgctcgcctactaccgccactgcctggagatccgggaggactggaaggtgttcaagtacaacttcaagccgctgtacaagtacagcaacctcggggagttctaccgcgacctggagaaggacacctacaacctggacctcgtccgggtgaactccgagtacgtggagaagaagcgcaacgagggcaagctgtacctgttcgaggtctacaacaaggacttcagcgacaagtccatcgggcgcaagaacatccacagcgactacttcaagtccctcttcctgcccgacaacctgaccaacaagaagatcgccctcgcggccgacgccgagatcttcttccgggagaagtccctgaagaacaaggacgagatcatcacccagaagaacaagatcaagatcgacaagaacaaccacaagggcgagaaggcctacagcaagaaccgctacacggacgacaagatcatcctgcacctccccatcaacctgaacttcggggagaacaagaaccacaaggacttcaactacgagatcaacgacagcctgctcaagaacaaccgggacatcaagatcatcggcatcgaccgcggcgagaagtacctgctgtactactccgtgatcgaccagaagggggacatcaaggagatgggcgacttcaacgtggtcaacggggtggactactacagcaagctcgtcgcctacgaggagaagcggaagcaggcgcgcctggactggggcgacatccagagcatcaaggagctgaaggaggggtacatctcccacgtgatccacgagatctgcgacctcatcaagaagtacaacgccatcgtggtcctggaggacctgagcatgggcttcaagcggggccgcttcttccgggagcgccaggtgtaccagaagttcgagctcgccctgttccggaagctgaactactgggtggacaagaacaaggaggagggggagaagggctccgccctcagcgcgtggcagctgacccccaacgagaaggacttcaaggtctcccagctggagaaggcccgccagctcgggatcctgttctacaccgccgccggctacaccagcaagacgtgcccggactgcgggttccggaagaacatcaccctgaagtacgtgaacgacaagcagctcaaggaggacctgggcaagctgaagatcaacttcgtggaggaccacttcaagatcaagtacaacctcctggacttcgagaagaacaagaagtccgagaaggccaaggacaccgtcctgcccaaggaggagcgcaagatcagcttcgtggcgaactccaaggtgatccggatccgctggcacgacatcaagaccaagctcgccaagcgggagctggacggcgagaagatcatcaagaagttccccaagggggtcatcaaggagtacgacatcaacatctgcctgaagcgcatcatcggcgacaagatcgacttcagcaaggactccatcacggagcagctcatcaacgggcggttcggcaaggacttctactgggagctgatgtacttcctgaacctcatcctggagatccgcaacgtggtgagcgagaccgagatcgactacatccagtgccccgtctgcggcttccactccgacgacgggttccgcggcaacaagttcaacggggacgccaacggcgcctacaacatcgcccggaaggggcgcctgatcctcgagaagatcaaccagcacaagaacctgaaggagctgaagaccggcgacctcagcgtgaacatcgtggagtgggacaaggcggtcaacaactgggacaagttcgtgcagggcgacaacaccgagtccaagaacatcgagatcccggccaaggaggagatgatcagcgtggaggtccgggagtcctga

SEQ ID NO: 2312 - RNA, 4107 nt, synthetic construct
  misc_feature 1..4107: note = Cpf1 variant
  source 1..4107: mol_type = other RNA
atgaagaaggagaaggagttcaagagcttcggcgacttcaccaacctgtacgagatctccaagaccctccgcttcgagctgaagcccgtggagaacacgcagaccatgctggacgaggccgacgtcttcgggaaggacaaggtgatcaaggacaagtacaccaagaccaagccgttcatcgacaagctccaccgggagttcgtggacgagagcctgaaggacgtctccctgagcggcctcaagaagtactccgaggtgctggagaactggaagaagaacaagaaggacaaggacatcgtgaaggagctgaagaaggaggaggagcgcctccggaaggaggtcgtggagttcttcgacaacacggccaagaagtgggcgaacgagaagtacaaggagctggggctgaagaagaaggacatcggcatcctcttcgaggagagcgtgttcgacctgctgaaggagaagtacggggaggagcaggactccttcctcaaggaggagaagggcgacttcctgaagaacgagaagggcgagaaggtcagcatcttcgacgagtggaaggggttcgtgggctacttcaccaagttccaggagacccgcaagaacttctacaagaacgacgggaccgagacggccctggccacccggatcatcgaccagaacctcaagcgcttctgcgacaacatcgacgacttcaagaagatcaagaacaagatcgacttctccgaggtggagaagaacttcaacaagaccgccgacgtcttcagcctggacttctacaaccagtgcctgctccagaagggcatcgactcctacaacgagttcatcgggggcaagaccctggagaacggcaagaagctgaagggggtgaacgagctcgtgaacgagtaccggcagaagaacaagaacgagaaggtcagcttcctgaagctgctcgacaagcagatcctgtccgagaaggagaagctgagcttcggcatcgagaacgacgagcagctcctggtggtgctgaactccttctacgagacggccgaggagaagaccaagatcctccgcaccctgttcggggacttcgtcgagcacaacgagaactacgacctggacaagacctacatcagcaaggtggcgttcaacacgatctcccacaagtggaccaacgagacccacaagttcgaggagctcctgtacggcgccatgaaggaggacaagcccatcggcctgaactacgacaagaaggaggacagctacaagttccccgacttcatcgccctcgggtacctgaagaagtgcctgaacaacctcgactgcgacaccaagttctggaaggagaagtactacgagaacaacgccgacaagaaggacaaggacaagggcttcctgaccgggggccagaacgcgtgggaccagttcctgcagatcttcatcttcgagttcaaccagctgttcaactccgaggccttcgacaacaaggggaaggagatcaagatcggctacgacaacttccggaaggacttcgaggagatcatcaaccagaaggacttcaagaacgacgagaacctcaagatcgccatcaagaacttcgccgacagcgtgctgtggatctaccagatggccaagtacttcgcgatcgagaagaagcgcggctgggacgacgacttcgagctcagcgagttctacacgaacccctccaacgggtacagcctgttctacgaccgggcctacgaggagatcgtccagaagtacaacgacctgcgcaactacctgaccaagaagccgtacaaggaggacaagtggaagctcaacttcgagaaccccaccctggccaacggcttcgacaagaacaaggagtccgacaacagcacggtgatcctgcggaagaagcgcaagtactacctcgggctgatgaagaagggcaacaacaagatcttcgaggaccggaacaaggccgagttcatccgcaacatcgagtccggggcctacgagaagatggcgtacaagtacctgcccgacgtggccaagatgatccccaagtgcagcacccagctcaacgaggccaagaaccacttccggaactccgccgacgacctggagatcaagaagtccttcagcaacccgctgaagatcaccaagcgcatcttcgacctcaacaacatccagtacgacaagaccaacgtcagcaagaagatctccggcgacaacaagggcatcaagatcttccagaaggagtactacaagatcagcggggacttcgacgtgtacaagtccgccctgaacgactggatcgacttctgcaaggacttcctgagcaagtacgactccacgaaggacttcgacttcagcatcctccggaagaccaaggactacaagtccctggacgagttctacgtcgacgtggcgaagatcacctacaagatcagcttcacccccgtgtccgagagctacatcgaccagaagaacaagaacggcgagctgtacctcttcgagatctacaaccaggacttcgccaaggggaagatgggcgccaagaacctgcacacgctgtacttcgagaacgtcttcagccccgagaacatctccaagaacttccccatcaagctcaacgggaacgccgagctgttcttccgccccaagagcatcgagtccaagaaggagaagcggaacttcgtgcgcgagatcgtgaacaagaagcgctacagcgaggacaagatcttcttccactgcccgatcaccctgaaccgggagaccggctccatctaccgcttcaacaactacgtcaacaacttcctcagcgagaacaacatcaacatcatcggcgtggaccgcggggagaagcacctggcctactactccgtgatcgacaagaacggcgtcaagatcgggggcggcagcttcaacgagatcaacaaggtggactacgcgaagaagctggaggagcgggccggggagcgggagcagtcccgcaaggactggcaggtcgtggagggcatcaaggacctcaagaaggggtacatcagccaggtggtgcgggagctggccgacctggccatcaagcacaacgcgatcatcgtcctcgaggacctgaacatgcgcttcaagcagatccggggcgggatcgagaagtccatctaccagcagctggagaaggccctcatcgacaagctgagcttcctggtggagaagggcgagaaggaccccaaccaggccggccacatcctcaaggcctaccagctggccgcgcccttcacctccttcaaggacatggggaagcagacgggcatcgtgttctacacccaggccagctacacctccaagacctgcccgaactgcgggttccgcaagaacaacaacaagttctacttcgagaacaacatcggcaaggcccaggacgccctgaagaagctcaagaccttcgagtacgacagcgagaacaagtgcttcgggctgtcctactgcctgagcgacttcgccaacaaggaggaggtcgagaagaacaagaacaagaagcggaacaacgcgccctacagcgacatcgagaagaaggactgcttcgagctctccacgaaggacgccgtgcgctaccggtggcacgacaagaacaccgagcgcggcaagaccttcttcgagggcgagagcgtgtacgaggagaaggaggagaaggagatcgggcagaccaagcggggcctggtcaaggagtacgacatctccaagtgcctgatcggcctcttcgagaagacggggctggactacaagcagaacctgctcgacaagatcaacagcgggaagttcgacggcaccttctacaagaacctgttcaactacctgaacctcctgttcgagatccgcaactccatcagcggcaccgagatcgactacatctcctgccccgagtgccagttccacaccgacaagagcaagacgatcaagaacggggacgacaacggctcctacaacatcgcccggaaggggatgatcatcctggacaagatcaagcagttcaagaaggagaacggcagcctcgacaagatggggtggggcgagctgttcatcgacctggaggagtgggacaagttcgcccagaagaagaacaacaacatcatcgacaagtga

SEQ ID NO: 2313 - RNA, 4149 nt, synthetic construct
  misc_feature 1..4149: note = Cpf1 variant
  source 1..4149: mol_type = other RNA
atgagcaagaacaacgtgtgggacaagttcaccaaccagtactccctgagcaagaccctccgcttcgagctgaagcccgtcggcaagacgcgggagaagatgaacgagcagctgaagtacgacaagcagctccagaccttcctgaaggaccaggagatcgaggacgcctaccagtacctgaagccgttcttcgacaagctccacaaggagttcatcaccgactccctggacagcgacaccacgaagaagatcgacttctccgactacctgatcgactaccgcgacaagaaggacctcaccaagaaggaggacagcctgcggaagaacatcggggaggtgttcgtgaaggccggcgaccgctggaagaaggagaagtaccccaagtacgagtggaagaaggggtccaacgtcgcgaacggcagcgggatcctgctcacccaggacgtgctgatgctgatcaaggacctcaaccccaacgaccagaagatcaagaagatgatcgaggagaccttcaagggcttcttcacgtacttctccggcttcaacctgaaccgggagaactactacaccaccaaggtggagaaggccaccgccgtcgccacgcgcatcgtgcacgacaacctgcccaagttctgcgacaacctcgtgcagttcgagtgcatcatcaagaagaagaagaacggggaggtcgaccggatcgagcgcaagagcgagtacctgaacgcctaccagtacctgaagtccaagggccggaccacccagatcaaggacgcggagagcgggaagatgatcgaggccgaggtgatcaacgagaacatgttctccatcagctacttctccgcctgcctcagccagtccggcatcgaggagtacaaccgcaccatcgggcactacaacctgctgatcaacctctacaaccaggccaaggagggcgaggagaaggacctgaagaagtccgagaagaagttcaagcggctgccgatcttcaagacgctctacaagcagatcggctgcggggagaaggagcccctgttcttcagcctgacccacgacaccaagctccaggtgcaggagaacaaggagaactacaagaagccctacagcgtcgagcagatcctggagcaggcgaagctggccggcgacaagtacttcaagggcaagagcaacgacgggatcctcaacaccatccccgagttctccgactacatcctgcagaaggagagctacggcggggtgtactggtccaaggtggccatcaacacgatcagcaaccgctacttcgagaactggcacaccctgaaggacgccctcatcgacgccaaggtcttcgagaagggcaagaagggggacgaggaggacgtgaagatcccggagtccatcgagctgcagggcttcttcgacgtgctggacacccaggaggggtggaagtccgagggcatcttcttcaagaagtccctcaccgaggagctgaagaacaaggaggcggacacgaagaacaagaagcggcgcgagatcgtcaaggaggccaagcggcccagccaggccctgctcgccctgctgttcgacgacatccaggagcacgccaacctcttcctgaaccagagcgacgagatcctgaagctcgagaagtacagcgagaaggagtccaaggagaagatcaagcagtggatggacagcgcgctggccgtgaaccgcatcctgaagtacttcttcgtgaaggagtccaaggccaagggcgagcagatcgaccccatcatcagcgaggccctgaaggtcctcttcaactccgaggacgccacctggttcaagtggtacgacgcgctgcggaactacctgaccaagaagccccaggacgacgtgaaggagaacaagctcaagctgaacttcgagaacagcaccctggccgggggctgggacatcaacaaggagtccgacaactactgcgtgatcctccaggaccagaaggggaagcagcacctgggcatcatcgccaagaaggagaagcagcgcgggtacaacaagatcttcgagcggacgccggagaaccccctgtacaagatcgacagcggcgaggtctggcagaagatggagtacaagcagatcgccgtgcccaccggcatcgggggcttcgtccgcaagtgcttcaacaccgcccagcagtacgggtggaagtgccccgacaactgcctcaactccgagggcaagatcatcatcaagaacgacgaggcgaaggagaacctggaggccatcatcgactgctacaaggacttcttcaccaagtacgagaaggacgggttcaagtacaagaacttcaacttcaacttcaaggagagcgaggagtacgaggagctgaacagcttcttctccgacgtggagcggcagggctacaagctcggcttcatcacggtgaacaagaccatcatcgacaagtgggtcgaggacgggaccatctacctgttcgagatcaagaaccaggacaccaacgacggcaagaaggacgggcacaagaacaacctgcacacgatctactggaaggccctcttcgaggacgtgggcaacaagccgaagctgaacggcggggccgagctgttctaccgcaaggcgctcctgaaggacaagcaggagaagatcgaggacaactacggcaaggagatcatcaagaacttccgcttcagcaaggagaagttcctgttccactgccccatcaagctcaactacaaggccaagtcctacagccaccccaagtacgccctgcccgagatcaacaagcagaccaacgagttcttcatcaccatctccgacatctgcttcctggggatcgaccggggcgagaagcacctcgcctactacagcctggtgaaccagaaggaggagatcatcgaccaggggaccctgaacatgccgttcgtcgacaaggacggcaagccccgctccatcaagaaggagaagttccggttcgacgccaaggtggacaagtgggtgagcgaggagatggactgctggaactacaacgacctcctggacgcgatggcctccaaccgcgacatggcccggaagaactggcagaccatcggcacgatcaaggagctgaagaacgggtacatcagccaggtcgtgcgcaagatcgtggacctcgccatcgacaagaaccggggcatcccctccttcatcgtcctggagaacctgaacgccgggttcatgcgcggccggcagaagatcgagaagtccgtgtaccagaagctcgagctggcgctggccaagaagctcaacttcgtggtcgacaagaccgtgcagaacggggagatcggcagcgtgaccaacgccctgcagctgacgcccccggtcaccaacttccagaacatcgagaaccgcaagcaggtcggcatcatgctctacacccgggccgactacaccagccagaccgaccccgtgacggggtggcgcaagtccatctacctgaagaagggcagcgaggagtacatcaagtcccagatcatggacagcttcgacgacttcgggttcgacggcaagaactactacttcaagtacaccgtggacctgatcgaccccatcaagaagaccagcgagaagaagttcaagaagcagtggaccctctactccgggatcaacggcaagagcctggaccggttccgcggcgagcggtccagcgacaagaacgtgtggatcaagacgctgcaggacatcaagaccaccctcgacgccgtgttcatcgggttcgacctgcagcactccctgcgcagccagatcatcaacgacggcatcatgcccaagaagatcgagaactcccagttcaccgggtgggagagcctccggttcgcgatcgagatgatccagcagatccgcaacatcggcgtcgagaagggggacgaggacttcatcctgtccccggtgcgggacaagaacgagaaccacttcgacagccgcaaggccaaggagaacgagcccaactccggcgacgccaacggcgcctacaacatcgcgcgcaaggggatcatcatgaacgagcacatcaagaaggacctgatccccttcatccaggacaaggagtgggacgcctggctcgccggccgggaggtgtgggacaagtggctgatcgagaacaaggacagcctgatctacaagaagtga

SEQ ID NO: 2314 - RNA, 4206 nt, synthetic construct
  misc_feature 1..4206: note = Cas9 variant mRNA product
  source 1..4206: mol_type = other RNA
atggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatga

SEQ ID NO: 2315 - RNA, 4989 nt, synthetic construct
  misc_feature 1..4989: note = Cas9 variant mRNA product
  source 1..4989: mol_type = other RNA
atggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatga

SEQ ID NO: 2316 - RNA, 3261 nt, synthetic construct
  misc_feature 1..3261: note = Cas9 variant mRNA product
  source 1..3261: mol_type = other RNA
atggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatga

SEQ ID NO: 2317 - RNA, 4329 nt, synthetic construct
  misc_feature 1..4329: note = Cas9 variant mRNA product
  source 1..4329: mol_type = other RNA
atggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatga

SEQ ID NO: 2318 - RNA, 3405 nt, synthetic construct
  misc_feature 1..3405: note = Cas9 variant mRNA product
  source 1..3405: mol_type = other RNA
atggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatga

SEQ ID NO: 2319 - RNA, 4266 nt, synthetic construct
  misc_feature 1..4266: note = Cas9 variant mRNA product
  source 1..4266: mol_type = other RNA
atggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatga

SEQ ID NO: 2320 - RNA, 3348 nt, synthetic construct
  misc_feature 1..3348: note = Cas9 variant mRNA product
  source 1..3348: mol_type = other RNA
atggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatga

SEQ ID NO: 2321 - RNA, 4104 nt, synthetic construct
  misc_feature 1..4104: note = Cas9 variant mRNA product
  source 1..4104: mol_type = other RNA
atggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatga

SEQ ID NO: 2322 - RNA, 4137 nt, synthetic construct
  misc_feature 1..4137: note = Cas9 variant mRNA product
  source 1..4137: mol_type = other RNA
atggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatga

SEQ ID NO: 2323 - RNA, 3270 nt, synthetic construct
  misc_feature 1..3270: note = Cas9 variant mRNA product
  source 1..3270: mol_type = other RNA
atggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatga

SEQ ID NO: 2324 - RNA, 3348 nt, synthetic construct
  misc_feature 1..3348: note = Cas9 variant mRNA product
  source 1..3348: mol_type = other RNA
atggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatga

SEQ ID NO: 2325 - RNA, 3354 nt, synthetic construct
  misc_feature 1..3354: note = Cas9 variant mRNA product
  source 1..3354: mol_type = other RNA
atggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatga

SEQ ID NO: 2326 - RNA, 3054 nt, synthetic construct
  misc_feature 1..3054: note = Cas9 variant mRNA product
  source 1..3054: mol_type = other RNA
atggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatga

SEQ ID NO: 2327 - RNA, 3465 nt, synthetic construct
  misc_feature 1..3465: note = Cas9 variant mRNA product
  source 1..3465: mol_type = other RNA
atggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatga

SEQ ID NO: 2328 - RNA, 4023 nt, synthetic construct
  misc_feature 1..4023: note = Cpf1 variant mRNA product
  source 1..4023: mol_type = other RNA
atggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatga

SEQ ID NO: 2329 - RNA, 4002 nt, synthetic construct
  misc_feature 1..4002: note = Cpf1 variant mRNA product
  source 1..4002: mol_type = other RNA
atggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatga

SEQ ID NO: 2330 - RNA, 4716 nt, synthetic construct
  misc_feature 1..4716: note = Cas9 variant mRNA product
  source 1..4716: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2331 - RNA, 5499 nt, synthetic construct
  misc_feature 1..5499: note = Cas9 variant mRNA product
  source 1..5499: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2332 - RNA, 3771 nt, synthetic construct
  misc_feature 1..3771: note = Cas9 variant mRNA product
  source 1..3771: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2333 - RNA, 4839 nt, synthetic construct
  misc_feature 1..4839: note = Cas9 variant mRNA product
  source 1..4839: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2334 - RNA, 3915 nt, synthetic construct
  misc_feature 1..3915: note = Cas9 variant mRNA product
  source 1..3915: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2335 - RNA, 4776 nt, synthetic construct
  misc_feature 1..4776: note = Cas9 variant mRNA product
  source 1..4776: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2336 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2337 - RNA, 4614 nt, synthetic construct
  misc_feature 1..4614: note = Cas9 variant mRNA product
  source 1..4614: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2338 - RNA, 4647 nt, synthetic construct
  misc_feature 1..4647: note = Cas9 variant mRNA product
  source 1..4647: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2339 - RNA, 3780 nt, synthetic construct
  misc_feature 1..3780: note = Cas9 variant mRNA product
  source 1..3780: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2340 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2341 - RNA, 3864 nt, synthetic construct
  misc_feature 1..3864: note = Cas9 variant mRNA product
  source 1..3864: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2342 - RNA, 3564 nt, synthetic construct
  misc_feature 1..3564: note = Cas9 variant mRNA product
  source 1..3564: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2343 - RNA, 3975 nt, synthetic construct
  misc_feature 1..3975: note = Cas9 variant mRNA product
  source 1..3975: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2344 - RNA, 4533 nt, synthetic construct
  misc_feature 1..4533: note = Cpf1 variant mRNA product
  source 1..4533: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2345 - RNA, 4512 nt, synthetic construct
  misc_feature 1..4512: note = Cpf1 variant mRNA product
  source 1..4512: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2346 - RNA, 4813 nt, synthetic construct
  misc_feature 1..4813: note = Cas9 variant mRNA product
  source 1..4813: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2347 - RNA, 5596 nt, synthetic construct
  misc_feature 1..5596: note = Cas9 variant mRNA product
  source 1..5596: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2348 - RNA, 3868 nt, synthetic construct
  misc_feature 1..3868: note = Cas9 variant mRNA product
  source 1..3868: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2349 - RNA, 4936 nt, synthetic construct
  misc_feature 1..4936: note = Cas9 variant mRNA product
  source 1..4936: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2350 - RNA, 4012 nt, synthetic construct
  misc_feature 1..4012: note = Cas9 variant mRNA product
  source 1..4012: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2351 - RNA, 4873 nt, synthetic construct
  misc_feature 1..4873: note = Cas9 variant mRNA product
  source 1..4873: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2352 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2353 - RNA, 4711 nt, synthetic construct
  misc_feature 1..4711: note = Cas9 variant mRNA product
  source 1..4711: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2354 - RNA, 4744 nt, synthetic construct
  misc_feature 1..4744: note = Cas9 variant mRNA product
  source 1..4744: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2355 - RNA, 3877 nt, synthetic construct
  misc_feature 1..3877: note = Cas9 variant mRNA product
  source 1..3877: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2356 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2357 - RNA, 3961 nt, synthetic construct
  misc_feature 1..3961: note = Cas9 variant mRNA product
  source 1..3961: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2358 - RNA, 3661 nt, synthetic construct
  misc_feature 1..3661: note = Cas9 variant mRNA product
  source 1..3661: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2359 - RNA, 4072 nt, synthetic construct
  misc_feature 1..4072: note = Cas9 variant mRNA product
  source 1..4072: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2360 - RNA, 4630 nt, synthetic construct
  misc_feature 1..4630: note = Cpf1 variant mRNA product
  source 1..4630: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2361 - RNA, 4609 nt, synthetic construct
  misc_feature 1..4609: note = Cpf1 variant mRNA product
  source 1..4609: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 2362 - RNA, 4497 nt, synthetic construct
  misc_feature 1..4497: note = Cas9 variant mRNA product
  source 1..4497: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2363 - RNA, 5280 nt, synthetic construct
  misc_feature 1..5280: note = Cas9 variant mRNA product
  source 1..5280: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2364 - RNA, 3552 nt, synthetic construct
  misc_feature 1..3552: note = Cas9 variant mRNA product
  source 1..3552: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2365 - RNA, 4620 nt, synthetic construct
  misc_feature 1..4620: note = Cas9 variant mRNA product
  source 1..4620: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2366 - RNA, 3696 nt, synthetic construct
  misc_feature 1..3696: note = Cas9 variant mRNA product
  source 1..3696: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2367 - RNA, 4557 nt, synthetic construct
  misc_feature 1..4557: note = Cas9 variant mRNA product
  source 1..4557: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2368 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2369 - RNA, 4395 nt, synthetic construct
  misc_feature 1..4395: note = Cas9 variant mRNA product
  source 1..4395: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2370 - RNA, 4428 nt, synthetic construct
  misc_feature 1..4428: note = Cas9 variant mRNA product
  source 1..4428: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2371 - RNA, 3561 nt, synthetic construct
  misc_feature 1..3561: note = Cas9 variant mRNA product
  source 1..3561: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2372 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2373 - RNA, 3645 nt, synthetic construct
  misc_feature 1..3645: note = Cas9 variant mRNA product
  source 1..3645: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2374 - RNA, 3345 nt, synthetic construct
  misc_feature 1..3345: note = Cas9 variant mRNA product
  source 1..3345: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2375 - RNA, 3756 nt, synthetic construct
  misc_feature 1..3756: note = Cas9 variant mRNA product
  source 1..3756: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2376 - RNA, 4314 nt, synthetic construct
  misc_feature 1..4314: note = Cpf1 variant mRNA product
  source 1..4314: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2377 - RNA, 4293 nt, synthetic construct
  misc_feature 1..4293: note = Cpf1 variant mRNA product
  source 1..4293: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2378 - RNA, 4439 nt, synthetic construct
  misc_feature 1..4439: note = Cas9 variant mRNA product
  source 1..4439: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2379 - RNA, 5222 nt, synthetic construct
  misc_feature 1..5222: note = Cas9 variant mRNA product
  source 1..5222: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2380 - RNA, 3494 nt, synthetic construct
  misc_feature 1..3494: note = Cas9 variant mRNA product
  source 1..3494: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2381 - RNA, 4562 nt, synthetic construct
  misc_feature 1..4562: note = Cas9 variant mRNA product
  source 1..4562: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2382 - RNA, 3638 nt, synthetic construct
  misc_feature 1..3638: note = Cas9 variant mRNA product
  source 1..3638: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2383 - RNA, 4499 nt, synthetic construct
  misc_feature 1..4499: note = Cas9 variant mRNA product
  source 1..4499: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2384 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2385 - RNA, 4337 nt, synthetic construct
  misc_feature 1..4337: note = Cas9 variant mRNA product
  source 1..4337: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2386 - RNA, 4370 nt, synthetic construct
  misc_feature 1..4370: note = Cas9 variant mRNA product
  source 1..4370: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2387 - RNA, 3503 nt, synthetic construct
  misc_feature 1..3503: note = Cas9 variant mRNA product
  source 1..3503: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2388 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2389 - RNA, 3587 nt, synthetic construct
  misc_feature 1..3587: note = Cas9 variant mRNA product
  source 1..3587: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2390 - RNA, 3287 nt, synthetic construct
  misc_feature 1..3287: note = Cas9 variant mRNA product
  source 1..3287: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2391 - RNA, 3698 nt, synthetic construct
  misc_feature 1..3698: note = Cas9 variant mRNA product
  source 1..3698: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2392 - RNA, 4256 nt, synthetic construct
  misc_feature 1..4256: note = Cpf1 variant mRNA product
  source 1..4256: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2393 - RNA, 4235 nt, synthetic construct
  misc_feature 1..4235: note = Cpf1 variant mRNA product
  source 1..4235: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2394 - RNA, 4420 nt, synthetic construct
  misc_feature 1..4420: note = Cas9 variant mRNA product
  source 1..4420: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2395 - RNA, 5203 nt, synthetic construct
  misc_feature 1..5203: note = Cas9 variant mRNA product
  source 1..5203: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2396 - RNA, 3475 nt, synthetic construct
  misc_feature 1..3475: note = Cas9 variant mRNA product
  source 1..3475: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2397 - RNA, 4543 nt, synthetic construct
  misc_feature 1..4543: note = Cas9 variant mRNA product
  source 1..4543: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2398 - RNA, 3619 nt, synthetic construct
  misc_feature 1..3619: note = Cas9 variant mRNA product
  source 1..3619: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2399 - RNA, 4480 nt, synthetic construct
  misc_feature 1..4480: note = Cas9 variant mRNA product
  source 1..4480: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2400 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2401 - RNA, 4318 nt, synthetic construct
  misc_feature 1..4318: note = Cas9 variant mRNA product
  source 1..4318: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2402 - RNA, 4351 nt, synthetic construct
  misc_feature 1..4351: note = Cas9 variant mRNA product
  source 1..4351: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2403 - RNA, 3484 nt, synthetic construct
  misc_feature 1..3484: note = Cas9 variant mRNA product
  source 1..3484: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2404 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2405 - RNA, 3568 nt, synthetic construct
  misc_feature 1..3568: note = Cas9 variant mRNA product
  source 1..3568: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2406 - RNA, 3268 nt, synthetic construct
  misc_feature 1..3268: note = Cas9 variant mRNA product
  source 1..3268: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2407 - RNA, 3679 nt, synthetic construct
  misc_feature 1..3679: note = Cas9 variant mRNA product
  source 1..3679: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2408 - RNA, 4237 nt, synthetic construct
  misc_feature 1..4237: note = Cpf1 variant mRNA product
  source 1..4237: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2409 - RNA, 4216 nt, synthetic construct
  misc_feature 1..4216: note = Cpf1 variant mRNA product
  source 1..4216: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2410 - RNA, 4530 nt, synthetic construct
  misc_feature 1..4530: note = Cas9 variant mRNA product
  source 1..4530: mol_type = other RNA
gggagaggcgctgcctacggaggtggcagccatctccttctcggcatcaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2411 - RNA, 5313 nt, synthetic construct
  misc_feature 1..5313: note = Cas9 variant mRNA product
  source 1..5313: mol_type = other RNA
gggagaggcgctgcctacggaggtggcagccatctccttctcggcatcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2412 - RNA, 3585 nt, synthetic construct
  misc_feature 1..3585: note = Cas9 variant mRNA product
  source 1..3585: mol_type = other RNA
gggagaggcgctgcctacggaggtggcagccatctccttctcggcatcaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2413 - RNA, 4653 nt, synthetic construct
  misc_feature 1..4653: note = Cas9 variant mRNA product
  source 1..4653: mol_type = other RNA
gggagaggcgctgcctacggaggtggcagccatctccttctcggcatcaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2414 - RNA, 3729 nt, synthetic construct
  misc_feature 1..3729: note = Cas9 variant mRNA product
  source 1..3729: mol_type = other RNA
gggagaggcgctgcctacggaggtggcagccatctccttctcggcatcaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2415 - RNA, 4590 nt, synthetic construct
  misc_feature 1..4590: note = Cas9 variant mRNA product
  source 1..4590: mol_type = other RNA
gggagaggcgctgcctacggaggtggcagccatctccttctcggcatcaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2416 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2417 - RNA, 4428 nt, synthetic construct
  misc_feature 1..4428: note = Cas9 variant mRNA product
  source 1..4428: mol_type = other RNA
gggagaggcgctgcctacggaggtggcagccatctccttctcggcatcaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2418 - RNA, 4461 nt, synthetic construct
  misc_feature 1..4461: note = Cas9 variant mRNA product
  source 1..4461: mol_type = other RNA
gggagaggcgctgcctacggaggtggcagccatctccttctcggcatcaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2419 - RNA, 3594 nt, synthetic construct
  misc_feature 1..3594: note = Cas9 variant mRNA product
  source 1..3594: mol_type = other RNA
gggagaggcgctgcctacggaggtggcagccatctccttctcggcatcaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2420 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2421 - RNA, 3678 nt, synthetic construct
  misc_feature 1..3678: note = Cas9 variant mRNA product
  source 1..3678: mol_type = other RNA
gggagaggcgctgcctacggaggtggcagccatctccttctcggcatcaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2422 - RNA, 3378 nt, synthetic construct
  misc_feature 1..3378: note = Cas9 variant mRNA product
  source 1..3378: mol_type = other RNA
gggagaggcgctgcctacggaggtggcagccatctccttctcggcatcaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2423 - RNA, 3789 nt, synthetic construct
  misc_feature 1..3789: note = Cas9 variant mRNA product
  source 1..3789: mol_type = other RNA
gggagaggcgctgcctacggaggtggcagccatctccttctcggcatcaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2424 - RNA, 4347 nt, synthetic construct
  misc_feature 1..4347: note = Cpf1 variant mRNA product
  source 1..4347: mol_type = other RNA
gggagaggcgctgcctacggaggtggcagccatctccttctcggcatcaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2425 - RNA, 4326 nt, synthetic construct
  misc_feature 1..4326: note = Cpf1 variant mRNA product
  source 1..4326: mol_type = other RNA
gggagaggcgctgcctacggaggtggcagccatctccttctcggcatcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 2426 - RNA, 4582 nt, synthetic construct
  misc_feature 1..4582: note = Cas9 variant mRNA product
  source 1..4582: mol_type = other RNA
ggggcgctgcctacggaggtggcagccatctccttctcggcatcaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2427 - RNA, 5365 nt, synthetic construct
  misc_feature 1..5365: note = Cas9 variant mRNA product
  source 1..5365: mol_type = other RNA
ggggcgctgcctacggaggtggcagccatctccttctcggcatcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2428 - RNA, 3637 nt, synthetic construct
  misc_feature 1..3637: note = Cas9 variant mRNA product
  source 1..3637: mol_type = other RNA
ggggcgctgcctacggaggtggcagccatctccttctcggcatcaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2429 - RNA, 4705 nt, synthetic construct
  misc_feature 1..4705: note = Cas9 variant mRNA product
  source 1..4705: mol_type = other RNA
ggggcgctgcctacggaggtggcagccatctccttctcggcatcaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2430 - RNA, 3781 nt, synthetic construct
  misc_feature 1..3781: note = Cas9 variant mRNA product
  source 1..3781: mol_type = other RNA
ggggcgctgcctacggaggtggcagccatctccttctcggcatcaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2431 - RNA, 4642 nt, synthetic construct
  misc_feature 1..4642: note = Cas9 variant mRNA product
  source 1..4642: mol_type = other RNA
ggggcgctgcctacggaggtggcagccatctccttctcggcatcaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2432 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2433 - RNA, 4480 nt, synthetic construct
  misc_feature 1..4480: note = Cas9 variant mRNA product
  source 1..4480: mol_type = other RNA
ggggcgctgcctacggaggtggcagccatctccttctcggcatcaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2434 - RNA, 4513 nt, synthetic construct
  misc_feature 1..4513: note = Cas9 variant mRNA product
  source 1..4513: mol_type = other RNA
ggggcgctgcctacggaggtggcagccatctccttctcggcatcaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2435 - RNA, 3646 nt, synthetic construct
  misc_feature 1..3646: note = Cas9 variant mRNA product
  source 1..3646: mol_type = other RNA
ggggcgctgcctacggaggtggcagccatctccttctcggcatcaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2436 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2437 - RNA, 3730 nt, synthetic construct
  misc_feature 1..3730: note = Cas9 variant mRNA product
  source 1..3730: mol_type = other RNA
ggggcgctgcctacggaggtggcagccatctccttctcggcatcaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2438 - RNA, 3430 nt, synthetic construct
  misc_feature 1..3430: note = Cas9 variant mRNA product
  source 1..3430: mol_type = other RNA
ggggcgctgcctacggaggtggcagccatctccttctcggcatcaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2439 - RNA, 3841 nt, synthetic construct
  misc_feature 1..3841: note = Cas9 variant mRNA product
  source 1..3841: mol_type = other RNA
ggggcgctgcctacggaggtggcagccatctccttctcggcatcaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2440 - RNA, 4399 nt, synthetic construct
  misc_feature 1..4399: note = Cpf1 variant mRNA product
  source 1..4399: mol_type = other RNA
ggggcgctgcctacggaggtggcagccatctccttctcggcatcaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2441 - RNA, 4378 nt, synthetic construct
  misc_feature 1..4378: note = Cpf1 variant mRNA product
  source 1..4378: mol_type = other RNA
ggggcgctgcctacggaggtggcagccatctccttctcggcatcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2442 - RNA, 4484 nt, synthetic construct
  misc_feature 1..4484: note = Cas9 variant mRNA product
  source 1..4484: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2443 - RNA, 5267 nt, synthetic construct
  misc_feature 1..5267: note = Cas9 variant mRNA product
  source 1..5267: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2444 - RNA, 3539 nt, synthetic construct
  misc_feature 1..3539: note = Cas9 variant mRNA product
  source 1..3539: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2445 - RNA, 4607 nt, synthetic construct
  misc_feature 1..4607: note = Cas9 variant mRNA product
  source 1..4607: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2446 - RNA, 3683 nt, synthetic construct
  misc_feature 1..3683: note = Cas9 variant mRNA product
  source 1..3683: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2447 - RNA, 4544 nt, synthetic construct
  misc_feature 1..4544: note = Cas9 variant mRNA product
  source 1..4544: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2448 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2449 - RNA, 4382 nt, synthetic construct
  misc_feature 1..4382: note = Cas9 variant mRNA product
  source 1..4382: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2450 - RNA, 4415 nt, synthetic construct
  misc_feature 1..4415: note = Cas9 variant mRNA product
  source 1..4415: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2451 - RNA, 3548 nt, synthetic construct
  misc_feature 1..3548: note = Cas9 variant mRNA product
  source 1..3548: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2452 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2453 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2454 - RNA, 3332 nt, synthetic construct
  misc_feature 1..3332: note = Cas9 variant mRNA product
  source 1..3332: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2455 - RNA, 3743 nt, synthetic construct
  misc_feature 1..3743: note = Cas9 variant mRNA product
  source 1..3743: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2456 - RNA, 4301 nt, synthetic construct
  misc_feature 1..4301: note = Cpf1 variant mRNA product
  source 1..4301: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2457 - RNA, 4280 nt, synthetic construct
  misc_feature 1..4280: note = Cpf1 variant mRNA product
  source 1..4280: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2458 - RNA, 4581 nt, synthetic construct
  misc_feature 1..4581: note = Cas9 variant mRNA product
  source 1..4581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2459 - RNA, 5364 nt, synthetic construct
  misc_feature 1..5364: note = Cas9 variant mRNA product
  source 1..5364: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2460 - RNA, 3636 nt, synthetic construct
  misc_feature 1..3636: note = Cas9 variant mRNA product
  source 1..3636: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2461 - RNA, 4704 nt, synthetic construct
  misc_feature 1..4704: note = Cas9 variant mRNA product
  source 1..4704: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2462 - RNA, 3780 nt, synthetic construct
  misc_feature 1..3780: note = Cas9 variant mRNA product
  source 1..3780: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2463 - RNA, 4641 nt, synthetic construct
  misc_feature 1..4641: note = Cas9 variant mRNA product
  source 1..4641: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2464 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2465 - RNA, 4479 nt, synthetic construct
  misc_feature 1..4479: note = Cas9 variant mRNA product
  source 1..4479: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2466 - RNA, 4512 nt, synthetic construct
  misc_feature 1..4512: note = Cas9 variant mRNA product
  source 1..4512: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2467 - RNA, 3645 nt, synthetic construct
  misc_feature 1..3645: note = Cas9 variant mRNA product
  source 1..3645: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2468 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2469 - RNA, 3729 nt, synthetic construct
  misc_feature 1..3729: note = Cas9 variant mRNA product
  source 1..3729: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2470 - RNA, 3429 nt, synthetic construct
  misc_feature 1..3429: note = Cas9 variant mRNA product
  source 1..3429: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2471 - RNA, 3840 nt, synthetic construct
  misc_feature 1..3840: note = Cas9 variant mRNA product
  source 1..3840: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2472 - RNA, 4398 nt, synthetic construct
  misc_feature 1..4398: note = Cpf1 variant mRNA product
  source 1..4398: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2473 - RNA, 4377 nt, synthetic construct
  misc_feature 1..4377: note = Cpf1 variant mRNA product
  source 1..4377: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 2474 - RNA, 4517 nt, synthetic construct
  misc_feature 1..4517: note = Cas9 variant mRNA product
  source 1..4517: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2475 - RNA, 5300 nt, synthetic construct
  misc_feature 1..5300: note = Cas9 variant mRNA product
  source 1..5300: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2476 - RNA, 3572 nt, synthetic construct
  misc_feature 1..3572: note = Cas9 variant mRNA product
  source 1..3572: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2477 - RNA, 4640 nt, synthetic construct
  misc_feature 1..4640: note = Cas9 variant mRNA product
  source 1..4640: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2478 - RNA, 3716 nt, synthetic construct
  misc_feature 1..3716: note = Cas9 variant mRNA product
  source 1..3716: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2479 - RNA, 4577 nt, synthetic construct
  misc_feature 1..4577: note = Cas9 variant mRNA product
  source 1..4577: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2480 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2481 - RNA, 4415 nt, synthetic construct
  misc_feature 1..4415: note = Cas9 variant mRNA product
  source 1..4415: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2482 - RNA, 4448 nt, synthetic construct
  misc_feature 1..4448: note = Cas9 variant mRNA product
  source 1..4448: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2483 - RNA, 3581 nt, synthetic construct
  misc_feature 1..3581: note = Cas9 variant mRNA product
  source 1..3581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2484 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2485 - RNA, 3665 nt, synthetic construct
  misc_feature 1..3665: note = Cas9 variant mRNA product
  source 1..3665: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2486 - RNA, 3365 nt, synthetic construct
  misc_feature 1..3365: note = Cas9 variant mRNA product
  source 1..3365: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2487 - RNA, 3776 nt, synthetic construct
  misc_feature 1..3776: note = Cas9 variant mRNA product
  source 1..3776: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2488 - RNA, 4334 nt, synthetic construct
  misc_feature 1..4334: note = Cpf1 variant mRNA product
  source 1..4334: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2489 - RNA, 4313 nt, synthetic construct
  misc_feature 1..4313: note = Cpf1 variant mRNA product
  source 1..4313: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2490 - RNA, 4466 nt, synthetic construct
  misc_feature 1..4466: note = Cas9 variant mRNA product
  source 1..4466: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2491 - RNA, 5249 nt, synthetic construct
  misc_feature 1..5249: note = Cas9 variant mRNA product
  source 1..5249: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2492 - RNA, 3521 nt, synthetic construct
  misc_feature 1..3521: note = Cas9 variant mRNA product
  source 1..3521: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2493 - RNA, 4589 nt, synthetic construct
  misc_feature 1..4589: note = Cas9 variant mRNA product
  source 1..4589: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2494 - RNA, 3665 nt, synthetic construct
  misc_feature 1..3665: note = Cas9 variant mRNA product
  source 1..3665: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2495 - RNA, 4526 nt, synthetic construct
  misc_feature 1..4526: note = Cas9 variant mRNA product
  source 1..4526: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2496 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2497 - RNA, 4364 nt, synthetic construct
  misc_feature 1..4364: note = Cas9 variant mRNA product
  source 1..4364: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2498 - RNA, 4397 nt, synthetic construct
  misc_feature 1..4397: note = Cas9 variant mRNA product
  source 1..4397: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2499 - RNA, 3530 nt, synthetic construct
  misc_feature 1..3530: note = Cas9 variant mRNA product
  source 1..3530: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2500 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2501 - RNA, 3614 nt, synthetic construct
  misc_feature 1..3614: note = Cas9 variant mRNA product
  source 1..3614: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2502 - RNA, 3314 nt, synthetic construct
  misc_feature 1..3314: note = Cas9 variant mRNA product
  source 1..3314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2503 - RNA, 3725 nt, synthetic construct
  misc_feature 1..3725: note = Cas9 variant mRNA product
  source 1..3725: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2504 - RNA, 4283 nt, synthetic construct
  misc_feature 1..4283: note = Cpf1 variant mRNA product
  source 1..4283: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2505 - RNA, 4262 nt, synthetic construct
  misc_feature 1..4262: note = Cpf1 variant mRNA product
  source 1..4262: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 2506 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2507 - RNA, 5235 nt, synthetic construct
  misc_feature 1..5235: note = Cas9 variant mRNA product
  source 1..5235: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2508 - RNA, 3507 nt, synthetic construct
  misc_feature 1..3507: note = Cas9 variant mRNA product
  source 1..3507: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2509 - RNA, 4575 nt, synthetic construct
  misc_feature 1..4575: note = Cas9 variant mRNA product
  source 1..4575: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2510 - RNA, 3651 nt, synthetic construct
  misc_feature 1..3651: note = Cas9 variant mRNA product
  source 1..3651: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2511 - RNA, 4512 nt, synthetic construct
  misc_feature 1..4512: note = Cas9 variant mRNA product
  source 1..4512: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2512 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2513 - RNA, 4350 nt, synthetic construct
  misc_feature 1..4350: note = Cas9 variant mRNA product
  source 1..4350: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2514 - RNA, 4383 nt, synthetic construct
  misc_feature 1..4383: note = Cas9 variant mRNA product
  source 1..4383: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2515 - RNA, 3516 nt, synthetic construct
  misc_feature 1..3516: note = Cas9 variant mRNA product
  source 1..3516: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2516 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2517 - RNA, 3600 nt, synthetic construct
  misc_feature 1..3600: note = Cas9 variant mRNA product
  source 1..3600: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2518 - RNA, 3300 nt, synthetic construct
  misc_feature 1..3300: note = Cas9 variant mRNA product
  source 1..3300: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2519 - RNA, 3711 nt, synthetic construct
  misc_feature 1..3711: note = Cas9 variant mRNA product
  source 1..3711: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2520 - RNA, 4269 nt, synthetic construct
  misc_feature 1..4269: note = Cpf1 variant mRNA product
  source 1..4269: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2521 - RNA, 4248 nt, synthetic construct
  misc_feature 1..4248: note = Cpf1 variant mRNA product
  source 1..4248: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2522 - RNA, 4433 nt, synthetic construct
  misc_feature 1..4433: note = Cas9 variant mRNA product
  source 1..4433: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2523 - RNA, 5216 nt, synthetic construct
  misc_feature 1..5216: note = Cas9 variant mRNA product
  source 1..5216: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2524 - RNA, 3488 nt, synthetic construct
  misc_feature 1..3488: note = Cas9 variant mRNA product
  source 1..3488: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2525 - RNA, 4556 nt, synthetic construct
  misc_feature 1..4556: note = Cas9 variant mRNA product
  source 1..4556: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2526 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2527 - RNA, 4493 nt, synthetic construct
  misc_feature 1..4493: note = Cas9 variant mRNA product
  source 1..4493: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2528 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2529 - RNA, 4331 nt, synthetic construct
  misc_feature 1..4331: note = Cas9 variant mRNA product
  source 1..4331: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2530 - RNA, 4364 nt, synthetic construct
  misc_feature 1..4364: note = Cas9 variant mRNA product
  source 1..4364: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2531 - RNA, 3497 nt, synthetic construct
  misc_feature 1..3497: note = Cas9 variant mRNA product
  source 1..3497: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2532 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2533 - RNA, 3581 nt, synthetic construct
  misc_feature 1..3581: note = Cas9 variant mRNA product
  source 1..3581: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2534 - RNA, 3281 nt, synthetic construct
  misc_feature 1..3281: note = Cas9 variant mRNA product
  source 1..3281: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2535 - RNA, 3692 nt, synthetic construct
  misc_feature 1..3692: note = Cas9 variant mRNA product
  source 1..3692: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2536 - RNA, 4250 nt, synthetic construct
  misc_feature 1..4250: note = Cpf1 variant mRNA product
  source 1..4250: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2537 - RNA, 4229 nt, synthetic construct
  misc_feature 1..4229: note = Cpf1 variant mRNA product
  source 1..4229: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 2538 - RNA, 51 nt, synthetic construct
  misc_feature 1..51: note = NLS2 variant
  source 1..51: mol_type = other RNA
atggcccccaagaaaaagagaaaagtgggcatccacggggtccctgctgca

SEQ ID NO: 2539 - RNA, 48 nt, synthetic construct
  misc_feature 1..48: note = NLS4 variant
  source 1..48: mol_type = other RNA
aagagacccgccgctaccaaaaaggcaggccaggccaaaaagaaaaag

SEQ ID NO: 2540 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgagtataaggttccctctaaaaagttcaaagtgctcggtaatactgatagacactcaatcaagaagaaccttattggcgctctgttgtttgacagtggggaaacggcagaggccaccaggttaaaacggacagcgcgccgacgttacactagaaggaagaatcggatctgctatctgcaggaaattttcagcaacgagatggctaaagtagatgactcctttttccatcgcctagaagagtcttttctcgtggaggaagataagaaacacgagagacatcctatcttcggaaatatagtcgacgaagtggcctaccacgagaagtatccaaccatctaccatctgaggaagaaacttgttgattcgacagacaaggcagatctgcggttgatttatctcgccctggctcacatgatcaaatttcgcggccacttcctgattgagggtgacctcaacccggataattcagacgtggacaagttatttatccaactggtccagacctacaaccagcttttcgaagagaatcccataaacgcaagcggggtggatgccaaagctattttgagtgcccgactgtccaagtctagaaggctagaaaatctcatcgcgcagctgcctggagagaaaaagaacggcctttttggcaatctgattgcattgagcctcgggctgactccaaacttcaagtccaattttgacttagccgaagatgctaaactgcaactctcaaaggacacatacgatgacgatcttgacaacctgttggcccagatcggagatcagtatgcagacctattcctggctgccaaaaacctcagtgatgcgatcctgcttagcgacattctgcgggtaaataccgagataacgaaggcccccttgtctgcatccatgatcaaacgttacgacgagcatcaccaggatctcactctgttaaaggctctggttcgccaacagctacctgaaaagtataaagagattttctttgaccagtcaaagaacggttacgccggctatatcgatgggggagctagccaggaagagttctacaaatttataaagccaattctcgaaaagatggacggcaccgaggagctgcttgtgaagttgaatagagaagatctgctcaggaagcaacggacattcgacaacggtagtatcccccatcagatccacctgggggagcttcacgccattctgcgacgccaggaagatttttatcctttcttgaaagacaatagagagaagatcgagaaaattctcacttttaggataccatactacgtcggaccgctggcacggggcaactctcgcttcgcctggatgaccagaaagtccgaagagacaatcaccccctggaattttgaagaggtggtggataaaggcgctagcgcgcaatcgttcattgaaaggatgacgaactttgacaagaatttacctaacgagaaggtcctgccaaaacattctctactctatgagtacttcactgtttataatgaactgacaaaggtgaaatacgtaaccgaggggatgcgtaagcccgcatttctttccggagaacagaaaaaggccatcgtggatttgctgttcaaaactaaccggaaggtcacagtgaagcagctcaaagaggactatttcaagaaaatcgaatgttttgattcagttgagattagtggtgtggaggaccgattcaatgctagcctgggcacctaccacgacttactgaagataatcaaagataaggactttcttgataacgaagagaatgaagacattttggaggatatcgtcctcacgctgaccctattcgaagacagagagatgattgaggaaaggctgaagacatatgcccatctctttgatgacaaagtgatgaagcagctgaaacgccggagatacactgggtggggaaggctttcccgcaagttgatcaacggcatacgagataaacaatctggtaagaccatcctggacttcttaaagagcgatgggtttgcaaaccggaatttcatgcagctcattcacgacgattcactgacatttaaagaggacatccagaaggcccaggtaagtggccaaggagactcccttcatgaacacattgctaacctggccggcagccctgcaatcaaaaaggggatattgcagactgttaaagtggtcgatgagctcgtgaaggtcatgggacgtcacaagccagaaaatattgtgatcgagatggcgagagagaaccagaccacacagaaaggtcaaaagaactctagggaacgcatgaaacggattgaggaaggcatcaaggagctggggtcacagatactaaaagagcatcccgttgaaaatacccagctgcagaatgagaagctctacctgtattaccttcaaaacggaagagacatgtatgtggatcaggaattggacatcaataggctgagtgattacgacgtagatcacattgtcccgcagagcttcttaaaagacgattccatcgacaacaaggtgctcactcgatctgataagaatcgcggcaaatcggacaacgttcctagcgaggaagtggtcaagaaaatgaagaattattggcggcaactgcttaacgctaaactgattacgcagagaaagtttgacaatctaacaaaggccgagaggggtgggctctccgagctggataaagcaggcttcatcaagcgtcagttggtggaaacccgccagataactaaacatgtagcccaaattctggactcacggatgaacaccaagtacgatgagaacgacaaattaatcagagaagtgaaggttatcacactcaagagtaaactggtctctgattttaggaaggacttccagttctataaagtgcgagagattaataactaccaccacgctcatgatgcctaccttaatgcagtggtcggaaccgctctgatcaagaaatatcccaagttggaaagcgagtttgtttacggcgactataaggtgtacgatgtgcggaaaatgattgccaagtccgagcaggaaatagggaaagcgactgccaagtatttcttttactcaaacatcatgaatttctttaaaacagagattacgctcgctaacggagaaatccgcaagagaccactgattgagaccaatggtgaaactggcgagatcgtatgggacaaggggagggatttcgcaacagtccggaaagtgctaagcatgcctcaggttaacatagtgaagaaaaccgaggtccaaacaggaggcttttctaaggaatccatcctgcccaaacgaaatagtgacaaacttattgcccgcaaaaaggattgggacccaaagaaatatggtgggttcgacagccccactgtggcttactctgttctcgtggtagccaaggtcgagaaaggcaagtccaaaaagctgaagtcagtgaaagaattgctgggaatcaccattatggagagaagtagctttgagaagaaccctatcgatttcttagaagcaaaaggctacaaggaggtgaaaaaggacctcataattaagctgccaaaatattcgctttttgaactggagaatgggaggaagcgtatgttggcgtccgccggagaactccagaaaggcaacgagctggctctaccgtctaagtacgtcaatttcctgtatcttgccagccactacgagaaactcaagggttcacccgaagataacgagcagaagcagctgttcgttgaacaacataaacactatttggacgagatcatcgaacagattagtgagttttccaagcgggtgatattagcagatgctaatctggacaaagtactctctgcctacaacaagcatagagataaacctatcagggagcaggcagaaaacattatccacctgttcacgcttaccaatctgggggccccagctgcgtttaagtatttcgacacaactattgatcgcaaacgatacaccagcacaaaggaggtgttggacgccactctaatccaccaatccataaccggactgtacgaaacgagaatcgatctctcacagctgggcggtgactga

SEQ ID NO: 2541 - RNA, 4890 nt, synthetic construct
  misc_feature 1..4890: note = Cas9 variant
  source 1..4890: mol_type = other RNA
atgaacttcaagatcctgcccattgccatagacctcggcgtgaaaaataccggggtctttagcgctttctaccagaagggaacatcccttgagagactggataacaaaaatggtaaggtttatgaattgtctaaagactcatacactttactgatgaacaataggacggcacggcgccaccaacgacgtggcatcgatagaaagcagctagtgaagaggctctttaaactgatttggaccgagcagcttaacctggaatgggacaaggatacacagcaagccatcagtttcttgtttaatcggcgcgggttcagctttattactgacggatattcccctgagtacctcaacatcgtaccagaacaggtgaaagcgatactgatggatatcttcgacgattataatggcgaggacgatctggactcttacctcaagttagctaccgagcaggaatcgaaaatttcagagatctataacaagctgatgcagaagattcttgaatttaaattgatgaagctgtgcacagatatcaaagacgacaaggtcagcaccaaaactctaaaggagataacaagttacgagttcgaactcctggccgattaccttgcaaattattccgagtctctgaaaacccaaaagtttagctacacggacaagcagggtaacttgaaagaactctcctattaccatcacgataagtataatattcaggagttcctgaaaagacatgccactatcaacgacaggattttagataccctgctcacagacgatcttgacatctggaattttaacttcgaaaagttcgattttgacaaaaacgaggagaagctgcagaatcaagaagataaggaccacatccaggctcatttgcaccacttcgtgtttgcagttaacaaaattaagtcagagatggccagtgggggacggcatcgcagccagtacttccaagaaataactaatgtgctagacgagaacaatcaccaggaaggctatctgaaaaacttttgtgagaatctccataacaagaaatactctaatctgtccgtcaagaaccttgtgaatctgatcggcaacttgtcaaatctcgagctgaagccgttacgaaaatacttcaacgataagattcacgctaaagccgaccactgggatgaacagaagtttaccgagacatattgccattggatcctgggggaatggagagtaggagttaaagaccaggataagaaggacggtgcgaaatacagctataaggatctatgtaatgagctcaaacaaaaggtgaccaaagcaggcctggtcgacttccttttggaactggatccctgcaggacgatacctccatacctcgacaacaacaatcggaagccccctaaatgtcagagtctgattcttaacccaaagtttctggataatcagtatcccaactggcagcaatacttgcaggagctcaagaaactgcagtctatccagaattatttagactccttcgagactgatctgaaggtgctaaaaagctcgaaggaccaaccttactttgtggaatacaaatcttccaaccagcagatcgcctcagggcagcgtgactataaggatctcgacgctcgcattctgcaattcatctttgatagagtcaaggccagtgacgagcttttgctgaatgaaatttacttccaggctaaaaagctcaaacagaaggctagctccgagctggagaaattagaatctagcaagaagctggatgaggttatagccaactcacaacttagtcagatcttgaaatcccagcacacaaatggaattttcgaacagggcacctttctccatctggtgtgcaagtattacaaacaaaggcagcgggcgcgagacagccgcctatatatcatgccagagtacagatatgataagaaactgcacaagtacaacaatactggtaggttcgacgatgacaaccagctcctgacatactgtaatcataagccgcggcagaaacgctatcaacttttgaacgatctggccggggtattacaggtgtctcccaattttctcaaggacaaaatcggatcagatgacgacctgttcattagtaagtggcttgtcgaacacataagaggctttaaaaaggcatgcgaggatagcctgaaaatccagaaggacaacaggggcttgctcaaccacaagattaatatcgctcgtaacaccaaagggaagtgtgagaaagaaattttcaatctgatctgcaagatagagggatccgaagataaaaagggtaactacaagcatggcctagcctatgagctgggggtgctcctgtttggagaacctaatgaggcttctaaaccagagttcgaccggaagatcaaaaagtttaactcgatttacagcttcgcccagatccaacagattgcatttgccgaacgaaaaggcaatgctaacacgtgtgcggtttgctccgcagataatgcccacagaatgcagcaaatcaagataaccgagcccgtggaagacaacaaggataaaattatcctttcagctaaggcccagaggttgcctgcaattccaacacgcatcgtcgacggtgccgtgaaaaagatggctactatactggccaaaaatatcgtagatgacaactggcagaatattaagcaggttttaagtgcaaagcatcaactccacatccccattatcaccgagtctaacgcgttcgaatttgagccggctctggccgatgtgaaagggaaaagccttaaagaccggagaaagaaagcactggagaggatatcccctgaaaatattttcaaggacaagaacaaccgcatcaaagagttcgccaagggcatctcagcttatagcggagccaatctaacagatggcgactttgatggggcaaaagaagaactcgaccacattatcccccgatctcataagaaatacggaactctgaacgatgaggctaatttgatttgcgtcacccggggtgacaacaagaataaaggcaaccgtatattctgtctgagagatttagccgacaattataagctcaagcagtttgaaacaaccgatgacctggagatcgaaaagaagattgcggatactatctgggacgccaacaaaaaggatttcaaatttgggaattacaggtccttcattaaccttacgccacaggagcagaaggcttttcgccacgcactgttcttggccgacgaaaatcctatcaagcaagctgtgatacgggccatcaacaatagaaacaggacatttgtcaatggaacccagcgatacttcgcagaggtgctcgcgaacaatatttatctgcgcgccaaaaaggagaacctaaacactgacaaaatcagttttgattacttcggcattcccaccatcggtaatgggcggggcatagctgaaattagacagctgtatgagaaggttgacagcgatatccaggcctacgcaaaaggagacaagccacaagcatcttattcccatcttatcgatgccatgctcgcattctgcattgccgctgacgaacacaggaacgatggctcaatagggctggagatcgacaagaattacagtttgtatcccctggataaaaacacaggagaagtgtttaccaaggacattttcagccagatcaaaattactgataatgagttttcggacaagaaattagtacgtaagaaggcgatcgagggtttcaacacacatcgccagatgacgcgggatggcatatacgccgaaaattacctccctatcctgattcacaaagagcttaacgaagtcagaaaggggtatacctggaaaaattccgaggaaatcaagatttttaaaggaaagaaatacgacatccagcaactgaacaatttggtgtattgtctcaagttcgttgacaagccaatatctattgatatccagatcagcactctggaggagctaaggaacattctgacaaccaataacatcgcagctacagccgaatactattacataaatcttaaaactcagaagctccacgagtattacattgaaaactacaacaccgccctgggctataaaaagtactcaaaagagatggagtttttgcgaagtttagcttatcggtccgaacgcgtgaagatcaagtctattgacgatgtcaaacaagtgctggacaaggatagcaatttcatcataggtaaaattacgctcccgtttaagaaagagtggcagagactgtacagggaatggcagaacaccacaatcaaggacgattatgagttccttaagtcctttttcaatgtaaaatcaatcactaagctgcataaaaaggtgcggaaagactttagcttgcccattagtaccaacgaagggaagttcctagttaagcgaaaaacatgggataataacttcatctaccagattctgaatgactctgattccagagcagacggcactaagccttttataccagccttcgacatcagcaaaaacgagattgtcgaggcgatcatcgattcgtttacctcaaagaatattttctggctccccaaaaacatagaactgcaaaaggtggacaataaaaacatctttgctattgatacgtctaagtggttcgaggtggaaacacctagtgaccttcgcgatatcggaattgccaccatccagtataagatagacaataactccaggccaaaagtccgtgttaagttagattacgtgatcgacgatgacagcaaaattaattactttatgaaccactctctgctcaagagccggtatcccgataaagtgttggagatcctgaagcagtccactattatcgagttcgagtcaagtggctttaacaagacaataaaagagatgctcgggatgaagctggcaggaatttacaatgaaaccagcaacaattga

SEQ ID NO: 2542 - RNA, 3162 nt, synthetic construct
  misc_feature 1..3162: note = Cas9 variant
  source 1..3162: mol_type = other RNA
atgaagagaaactacatcctgggcctcgacattgggataaccagcgtgggatatggtatcattgattacgagacaagggacgtcatcgatgccggcgttcggcttttcaaagaagctaatgtggagaacaatgaagggcgccgatccaagcgtggagcaagaaggctgaaacggcgcagaaggcaccggattcagcgcgtaaagaaattgttatttgactataacctgctaactgatcattctgagctctcaggcatcaatccctacgaagcccgagtgaagggtctgagtcaaaaacttagcgaggaggagttctccgcggctctgttgcacctcgccaaaagaaggggagtccataacgtgaatgaagttgaagaggacacggggaacgagctgtctaccaaggaacagatatcgcgtaattcaaaagcactggaggaaaagtatgtggccgagctccagttagaacggctgaaaaaggatggcgaggtccgcggcagcatcaacagatttaagacaagtgactacgtgaaagaggctaagcagcttttgaaagtacaaaaggcatatcaccagctggatcagtccttcattgacacttacatcgatctactcgaaaccaggcggacatactatgaggggcctggagaaggttctccatttggctggaaagacattaaggagtggtacgaaatgctgatggggcattgcacctatttcccggaggagcttcgaagcgttaaatacgcctataatgctgatctgtacaacgccttgaatgacctcaacaatctggtgatcactcgcgacgaaaacgagaagttagaatattacgagaagtttcagataattgaaaacgtcttcaaacaaaagaaaaagcccacactgaaacagatcgcgaaggagattctcgtgaatgaggaagatatcaagggatacagagtgacctccacgggcaaacctgagtttactaaccttaaggtctatcacgacatcaaagatattaccgcaaggaaggaaataatcgagaatgccgagctgttggaccagattgctaaaatcctaacaatataccagtcaagtgaagatattcaagaggaactgactaacctcaatagcgagctgacccaggaagagatcgagcagatctctaaccttaagggttatacagggacccacaatctgtccttgaaggccattaacctcatcctggacgaattatggcatacgaatgataaccaaattgcaatattcaatcggctgaagctagttccaaagaaagtggacctctcacagcagaaggagatccccactacactggtagatgactttattcttagccctgtggtcaaacgcagtttcatccagtctatcaaggtgattaacgctataatcaagaaatacggattgccaaatgatattatcattgaactggccagagagaagaactccaaagacgcgcaaaagatgatcaatgaaatgcagaaaaggaaccgtcagaccaacgagcggatagaggaaatcattcgaactacaggcaaggagaatgccaaatatctcatcgaaaagattaagctgcacgacatgcaggagggcaaatgtctttacagcctggaagcaatccccttggaggatctcctgaacaatccttttaactatgaggttgaccatataattccaagatcggtgtctttcgataattccttcaacaataaggtcttagtgaaacaagaagagaactcaaagaaagggaataggaccccgtttcagtacctgagtagctccgactctaagatcagctacgaaacgttcaagaaacacattctaaacctcgctaagggaaaaggtcgcatctcaaagaccaaaaaggagtatctgcttgaggaacgggatataaatagatttagtgtacagaaggacttcatcaacaggaatttggttgatacacgctacgccactcgaggcctgatgaacctcctgcggtcctattttcgtgtgaataacttagacgtcaaagtgaaaagcattaacgggggattcacctcttttctgagaaggaaatggaagttcaaaaaggagcgcaataagggctacaaacaccatgctgaagatgcccttatcattgcaaacgccgactttatcttcaaggagtggaaaaagttggataaagctaagaaagtcatggaaaatcagatgtttgaggagaagcaagcggaatcaatgcccgagatagaaacagagcaggaatataaggagattttcatcactcctcaccagatcaaacatattaaggactttaaagattacaagtatagtcaccgggtggacaaaaagccaaacagagagctcatcaatgacaccctgtacagcacaaggaaggatgacaaaggtaacaccctaattgttaataacctgaatgggctctacgataaggacaacgataaactgaagaaacttataaataagtcccccgaaaagttgctgatgtatcatcacgaccctcagacttaccaaaaattaaagctcatcatggagcagtatggcgatgagaaaaacccactgtacaagtattacgaagaaacgggaaattatcttacaaaatactctaagaaggacaacggccccgtgattaaaaagatcaaatactatgggaataagctgaacgcacacttggatattaccgacgattacccgaactcgcgaaataaagtagtcaagctcagcctgaagccttatcgcttcgacgtgtacctagataacggagtttataaattcgtgactgtcaagaatctggacgtgatcaaaaaggagaactactatgaggtaaattccaaatgctacgaagaggccaagaaactcaagaagatatcaaaccaggctgaatttatcgccagtttctacaataacgacctgattaaaatcaatggtgagctttatcgggtgattggcgttaacaatgatttgctgaacagaatcgaggtcaatatgatagacattacctacagggaatatttagagaacatgaatgataagcgtcccccacgcatcatcaaaacaattgcatctaagacccaaagcatcaaaaagtactccactgacatactcgggaacctgtatgaagtgaagtcaaagaagcatcctcagattatcaaaaagggatga

SEQ ID NO: 2543 - RNA, 4230 nt, synthetic construct
  misc_feature 1..4230: note = Cas9 variant
  source 1..4230: mol_type = other RNA
atgctgttcaacaagtgcatcattataagcatcaatctcgacttttccaacaaagagaagtgtatgaccaaaccctactctattggccttgatatcgggacaaattcagtgggatgggccgtcattactgacaactataaggttcctagtaaaaagatgaaggtgctgggtaatacgagcaaaaagtacatcaaaaagaacttgttaggcgtactgctattcgattccgggataaccgctgaaggaagaaggctcaaacggacagcacgccgacgttatactagaaggcggaatcgcatcctgtaccttcaggagatttttagtaccgaaatggccacactggacgatgcgttctttcaaagattggacgattcgttcctcgtgccagacgataagagggactcaaagtatccgatctttggcaacctggtcgaggaaaaagtgtaccacgatgagttccccaccatttatcatctgcggaagtacctcgctgacagcactaaaaaggccgatttacgcctggtttaccttgcattggcccacatgatcaaatatcgaggtcattttctgatagagggggagttcaatagtaagaacaatgacattcagaaaaactttcaggacttcctagatacatacaatgctatctttgaatccgacctctctctggaaaacagcaagcagcttgaggagattgtgaaggataaaatctccaagctggaaaagaaggacagaatcttgaaactcttccctggagagaaaaattcaggcattttcagtgaatttctgaagttaatagtcggcaaccaagcagatttcaggaaatgctttaacctggacgagaaggccagcctccacttctctaaagaatcctatgatgaggaccttgagaccctgttggggtacatcggagatgactattcagatgtgtttctaaaggctaaaaagctgtacgacgccattctcctgagcggtttccttacggtaactgacaatgaaaccgaggcgccactgagttctgcaatgatcaagcggtataacgaacataaagaggatttggccctcctgaaggaatacatacgtaatatttccttaaaaacatacaacgaggtttttaaggacgatactaaaaatggctatgctgggtacatcgacggaaagaccaaccaggaggatttctatgtgtacctgaagaatctactcgccgaatttgagggcgcagactatttcctggaaaagatcgatcgcgaggactttcttagaaagcagaggacattcgataacggtagcattccctaccagatccacttgcaagaaatgcgggctattctggacaaacaggccaagttttatcctttcctcgcgaaaaataaggagcgaatagagaaaatcctgaccttccgcattccatactacgtcgggccccttgccagaggaaactcggattttgcatggtctatcaggaagcggaatgaaaagatcacgccttggaacttcgaggacgtgattgataaagaatcctcagctgaggcctttataaatcgcatgacttctttcgacctgtatttgccagaggaaaaggtgctcccgaaacacagcctgttatacgagacatttaacgtctataatgaactgaccaaggttagattcatcgctgagtccatgagggactaccagtttctagattctaaacagaagaaggacattgtgcgtctctatttcaaagataagcggaaagtaactgacaaggatatcattgaatacctgcatgccatctatggctacgacggcatagagcttaaagggatcgagaagcaatttaacagctcattgagtacataccacgatctgctcaacattatcaatgacaaggagttcctggatgactccagcaacgaagcaattatcgaagagataattcataccttaacgatctttgaagatcgagagatgattaaacagagactgtctaagttcgagaatatctttgacaaatcagtgcttaagaaattgagtaggcgccactataccggatggggtaagctcagcgccaagctgataaacggcatccgggatgaaaaatccgggaatacaattctagactacctgatcgacgatggaatttctaacagaaatttcatgcagctcatccacgacgatgctctgtcgttcaagaaaaagatacaaaaagcgcagattatcggcgacgaggataagggtaacatcaaagaagtcgttaagagccttcccgggtcccctgcaattaagaaaggcatcttgcagtcaattaagatagtggacgagctggtgaaagtcatgggaggcaggaagccagaaagtatcgtggtagagatggcccgcgagaatcagtatactaaccaagggaaatctaatagccagcagcgattaaagcggctcgaaaagtccctgaaagagcttggatcaaagattctgaaagaaaacatccccgctaagttgagcaaaattgataataacgccctccagaatgaccgtctgtacctatattacctgcaaaacggtaaggatatgtataccggcgacgatctcgacatcgacagactgtctaactacgatatagaccatatcattcctcaggcatttcttaaggataattccatcgacaacaaagttttggtgagtagcgcctctaatagggggaagtccgatgacttcccatcactggaggtcgtgaaaaagcgcaaaacattttggtaccagttactcaagagtaagctgattagccagcggaaattcgataaccttactaaggctgagagaggaggcctgctacccgaagacaaagccggttttatccaaaggcagctcgtcgagacccgacagataacaaagcacgtggcacgcctgttggatgaaaaattcaataacaagaaggacgagaataaccgggcggttagaaccgtgaaaattatcactctgaagtcgacgttagtatcccagtttaggaaagatttcgaactctataaggtccgtgagatcaatgactttcatcacgctcatgatgcctacctgaacgcagtgattgcctctgcccttctgaaaaagtatccgaaattggagcctgagttcgtttacggggactatcccaagtacaatagctttcgcgaacggaagtcagctacagaaaaagtgtatttctacagtaacataatgaatatcttcaagaaatccatttctctcgcagacggcagagtcatcgagaggccactgattgaagtgaacgaggagaccggagaaagcgtatggaataaggagtccgatctagctactgtgcgacgggttctgtcataccctcaagtcaacgtggtgaaaaaggtcgaggaacagaaccacggccttgaccgcgggaagcccaaaggactctttaatgccaacctgagcagtaagccaaaacccaattctaacgaaaatttggttggtgcgaaggagtatctggatcctaaaaagtacggcgggtatgccggaatctccaacagcttcgctgtgttagtgaagggcaccatagagaaaggtgcaaagaaaaagatcacaaatgtactcgaatttcaggggatttcgatcctggacagaattaactacaggaaagataaacttaatttcctgttggagaagggctataaagacatcgaactcataattgagctgccaaagtactcactatttgagctgtctgatggaagtcggcgaatgcttgcctccatcctcagcaccaacaataaaagaggcgaaatccacaaggggaaccaaattttcctgtctcagaaatttgtcaagttgttatatcatgctaaacgcatcagcaatactataaacgagaatcacaggaagtacgtggaaaaccataagaaagagttcgaggaactgttttactatattctcgagttcaatgaaaactacgttggagccaagaaaaacggcaagctgcttaattccgcatttcagtcatggcagaaccacagtatcgacgagctgtgtagctctttcattggtccgacagggtccgaacgtaaaggattgtttgagctaacgtcacggggcagtgcggccgatttcgagttcctgggtgtgaagatccccagatatagggactacacccctagctccctcctgaaggatgctactcttatacaccaatctgtcacaggcttatatgaaacccgcattgacctggccaaactcggggagggatga

SEQ ID NO: 2544 - RNA, 3306 nt, synthetic construct
  misc_feature 1..3306: note = Cas9 variant
  source 1..3306: mol_type = other RNA
atgtggtacgccagcctgatgtccgctcaccatctcagagtgggcatcgacgtcgggacccactctgttggacttgcaacactgagggtggatgaccatggtactcccattgagttgttatcagccctgagtcacatacatgatagcggcgtagggaaggaaggaaagaaggaccacgatacgcggaaaaagctatccggcatcgcgcgccgagctcgtagactcctgcaccataggcggacccagcttcaacagctggacgaggtgttgcgcgatctcggtttccctattccaacaccgggggaatttctggacctgaacgagcagactgatccctatagagtctggagggtgcgggcccgcctcgttgaagagaaattacctgaggaactgcgaggaccagcaatctctatggccgtgagacacattgctaggcatcggggctggcgtaatccctactcgaaggtcgagtcacttttgagccctgcagaagagagtccattcatgaaggccctgcgcgagagaatcctagctaccacaggcgaagtgctcgacgatgggataacccccggacaggccatggcgcaagtagcactgactcacaacatctccatgaggggtcctgagggcattcttgggaaactgcaccagtctgacaatgccaacgaaatccggaagatttgcgctcgacagggagttagcccagatgtgtgtaaacagttgctccgcgccgtctttaaggcagactccccgagaggctcagctgtgagtagggtggcccccgaccctctgccaggtcaagggagcttccggcgcgcgcccaaatgcgatcctgagtttcagagattcaggatcatatctattgtcgccaatttacgtatctccgaaacaaagggagagaaccggccactgaccgcagacgagcgaagacatgttgtgacgtttctcactgaagattcacaggctgaccttacctgggtagatgtggccgagaagctgggcgtccacaggcgcgacttgcggggcacagctgtgcatactgatgacggggaaagaagcgccgcaaggcccccgattgatgccaccgaccgcatcatgcgacagacaaaaatcagttctctaaagacctggtgggaggaagctgattccgagcaacggggagcgatgattcgttatctgtacgaggaccctacggacagcgaatgtgcagagataatcgccgaactccccgaggaagatcaggctaaactggactcgcttcatctgccagccggtagagcagcctattctagggagtccttgactgctctctcagatcacatgctggccacaaccgacgatttacacgaggcacgcaagcggctgttcggcgttgacgatagttgggcgcctcccgctgaagccattaatgcaccagtggggaaccccagcgtcgacagaactctaaaaatcgtgggaaggtacctctccgccgtagagtctatgtggggcacacctgaagttatacacgtggagcatgtccgagatggttttaccagcgagcgcatggctgacgaacgggataaggccaatagaaggcgttataacgacaatcaggaggcaatgaaaaagattcaacgcgattacgggaaggaaggctacatctcacggggagacatcgtgagactggacgctcttgagttgcagggctgcgcctgtctgtattgcgggacgaccattggataccacacatgtcagctcgatcatatcgtcccacaggcgggtccgggcagtaacaataggcgagggaacctggtggccgtttgcgaacggtgtaatcgctccaaaagcaacactcccttcgctgtgtgggcacaaaagtgcggcattcctcacgtaggagtcaaagaggccataggtagagtgagggggtggcggaagcagaccccaaacacatcttcagaggaccttactcgactgaaaaaggaagttatcgctagattgcgcaggacccaggaggatcccgaaattgacgagcgtagtatggaaagcgtggcctggatggcaaatgagctccaccatcggatcgcggccgcttatcctgagacaaccgtcatggtgtacagaggctccatcactgccgcagctaggaaggccgcaggaattgattctcgcataaacctgatcggcgaaaaagggcgaaaggacagaattgatcggaggcaccatgccgtagacgcttcggtggttgcgttaatggaggccagcgtcgcaaaaacgctggctgaacgctcctcactacgtggagagcagagactcacaggtaaggaacaaacctggaaacagtatactggcagtaccgtgggggcccgggagcactttgagatgtggaggggacatatgctgcaccttacagaattgttcaatgagcgcctggccgaagataaggtgtacgtcacccagaacatccgactcagactgtctgacggcaatgctcacactgttaacccaagcaagttagtgtcccatcggctgggtgatgggcttacagtgcagcaaattgacagggcatgtacgcccgccttgtggtgcgcgctcacccgcgagaaagattttgacgagaagaatggcctgccggctagagaagacagggccatccgggtacacggacatgagataaaatcaagcgattatatccaggtcttctctaagcgtaaaaagactgactccgatcgcgacgaaacacctttcggcgcaattgccgtgcgagggggatttgttgagatcggcccaagtattcaccatgctagaatctacagggtggaaggtaagaaacccgtctacgcaatgctacgggtgttcacccacgatctgctcagccagcgccacggggacctgttttctgccgttatacctccccagtccatttcaatgagatgcgcggagccaaaacttaggaaagctatcacaactggaaacgccacctatttgggctgggtggtagtcggtgatgagctggaaattaatgtggacagtttcacgaagtacgcaatcggccggtttttagaggatttccctaacaccacacgatggagaatatgtgggtatgacactaatagcaaactcaccctgaagcccatcgtgcttgccgctgaaggactggagaacccatcgtccgccgtcaatgaaattgttgagttgaaaggctggcgcgtggcaatcaacgtactcacaaaggtgcatccgactgtcgtgaggcgggatgctctggggcgtcctagatactctagcaggtcaaatctacccaccagttggacgattgagtga

SEQ ID NO: 2545 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcactacggataattataaagttccttctaagaaaatgaaggtgctcggtaacacctcaaagaagtacataaagaaaaatcttctgggcgtattgttattcgacagtgggatcacagctgagggaagaaggctgaagcggactgcacgccgacgttataccagaaggcggaaccgcattctatacctccaggaaatctttagcacagagatggccaccctggatgacgcgttctttcaaagacttgatgactccttcctggtgccagatgacaaaagggattctaagtatccgatttttggcaatttggtcgaagagaaggcttaccacgacgagttccccactatctatcatctccggaagtacctggccgattcgacaaagaaagcagacctgcgcctcgtgtacttagccctggctcacatgataaagtatcgaggtcattttcttatcgagggggagttcaactcaaagaataacgatattcagaagaattttcaggacttcttggacacctacaacgcaatctttgaaagcgatctgagtctagaaaattccaaacagctcgaagagattgttaaggacaaaatctctaagctggagaagaaagatagaatacttaagctgttccctggagaaaagaacagcggcatcttttccgagttcttgaagctcattgtgggcaatcaagccgacttcaggaaatgctttaacctggatgaaaaggcttcattacacttcagtaaggagagctatgacgaagatctggagacgctccttgggtacattggagacgattattctgacgtctttctgaaagccaagaaattgtacgatgcgatcctactgtccggtttcctcactgtgaccgacaatgagacagaagcaccactgtcaagcgccatgatcaagcggtataacgagcataaagaagaccttgctctgttgaaggagtacattcgtaacataagtctcaagacttacaatgaagtatttaaagatgacaccaagaacggctatgccgggtacatcgatggaaaaacaaatcaggaggacttctatgtttacctgaagaaattactggcagagtttgaaggcgctgattatttcctagagaagattgaccgcgaagattttctcagaaagcagaggaccttcgacaacggttctatcccctaccagatacatctgcaagagatgcgggccattcttgataaacaggcgaagttttatcctttcttggccaaaaataaggaacgaatcgagaaaatcctgacgtttcgcattccatactacgtggggcccctcgcaagaggaaactccgacttcgcttggagcatcaggaagcggaatgagaaaattactccttggaacttcgaagatgtcatagacaaggagtcgtctgccgaggcttttatcaatcgcatgacatccttcgatctgtatcttccagaagagaaggtgctgccgaaacactcattgctctacgaaacctttaacgtgtataatgagctgactaaggtcagattcattgccgaaagtatgagggactaccagtttttagacagcaaacagaagaaagatatcgttcgtctgtatttcaaggacaagcggaaagtgacagataaggacatcattgagtacctacacgcaatatatggctacgatggcatcgaactcaaagggattgagaagcaatttaactcctctctgagcacctaccacgaccttttgaatatcattaacgataaagagttcctggacgattcaagtaatgaagccatcatagaggaaatcattcatacgctcaccatctttgaggaccgagaaatgattaagcagagactgtccaagttcgagaacatctttgataaaagcgtattaaagaaactgtctaggcgccactatacaggatggggtaaactttcagctaaattgataaacggcattcgggacgagaagagtgggaatactatcctcgattacctgattgacgacggaatcagcaacagaaatttcatgcagctaatacacgatgacgcgctgtcctttaagaaaaagatccaaaaagcacagattatcggcgatgaagacaagggtaacattaaagaggtggtcaagtctctccccgggtcgcctgccatcaaaaagggcatactgcagagcattaagatcgtggatgaacttgttaaagtgatgggaggcaggaagccagagtccatcgtcgtggaaatggctcgcgagaatcagtataccaaccaagggaaatcaaatagtcagcagcgattgaagcggctggagaaatctttaaaggaactcggaagcaagattctgaaagagaacatccccgccaaactttccaaaattgacaataacgcactgcagaatgatcgtttgtacctctattacctgcaaaacggtaaggacatgtatacaggcgatgacctagatatagacagactgtcaaattacgacatcgatcatattatccctcaggccttcctcaaagacaacagcattgataataaggtactggtttcttccgctagtaacaggggaaagagcgacgatgtgccatctcttgaagtcgtgaaaaagcgcaaaactttctggtaccagttgctgaagtccaaattaatctcacagcggaagtttgacaacctcaccaaggccgagagagggggcctgagtcccgaggataaagcaggtttcatacaaaggcagcttgtcgaaacacgacagatcaccaagcacgtggcgcgcctgctagacgagaaatttaataacaagaaagatgaaaataaccgggctgttagaactgtgaagattatcacgctcaagagcacactggtatcgcagttcaggaaagactttgagttgtataaggtccgtgaaattaatgatttccatcacgcccatgacgcatacctgaacgccgtggttgcttccgccttactcaaaaagtatccgaaactggagcctgagtttgtgtacggggattatcccaagtacaattctttccgcgaacggaaaagcgcaaccgagaaggtctatttttactcaaacatcatgaatatattcaagaaaagtatttcccttgctgacggcagagtgatcgaaaggccactgatcgaggtaaacgaagagactggagagtctgtgtggaataaggaaagcgacttggccaccgttcgacgggtcctctcctaccctcaagtgaacgtggtcaaaaaggttgaggaacagaatcacggcctggatcgcgggaaacccaagggactatttaacgcgaatctgtcaagcaagccaaaacccaacagtaacgagaatcttgtgggtgccaaggaatatctcgaccctaaaaagtacggcgggtatgctggaatttctaactccttcacagtgctggtaaaaggcaccatagagaagggtgcaaagaaaaagatcactaatgtcttggagttccaggggattagcatcctggatagaattaactacaggaaagacaagttaaattttctcctggaaaaaggctataaggatatcgagcttataatcgaactgccaaagtactcgttgttcgagctctcagacggatctcggcgaatgctggccagtattctatccacaaacaataaaagaggcgagatccacaaggggaaccaaatttttctgagccagaaattcgtgaaacttctctatcatgctaaacgcatctctaatacgataaacgaaaatcacaggaagtacgttgagaaccataaaaaggaatttgaggaactgttctactatattttggagtttaatgagaactacgtgggagccaagaaaaatggcaagttactgaacagcgcattccagtcctggcagaatcactcaatcgatgaactctgtagtagctttatcggtccgaccgggtctgagcgtaaaggactgttcgaacttacttcccggggctcagcggccgactttgagttcctgggtgtcaagattcccagatatagggattacacacctagtagcttgctaaaagacgctaccctgatccaccaatccgtgacaggcctctatgaaactcgcatagatctggccaaacttggggagggatga

SEQ ID NO: 2546 - RNA, 3249 nt, synthetic construct
  misc_feature 1..3249: note = Cas9 variant
  source 1..3249: mol_type = other RNA
atggccgctttcaagcccaacagcatcaattacattctgggcctcgacatagggatcgcatccgtgggatgggccatggtcgagattgatgaagaggaaaaccctatcagacttattgacctgggtgttagggtgtttgagcgggcggaagtaccaaaaaccggcgattctttggctatggcccgccgattagcacgttcagtgagaaggctgacacggcgcagagcccacaggctactccggactcgccgactgcttaagagagagggggtcctgcaggctgcaaatttcgacgagaacggattgatcaaaagtctcccgaatacgccctggcaactgagggccgctgccctggatcggaagctcacccctttagaatggagcgcggtgctgcttcatttgataaaacaccgtggctatctgtcccagcgcaagaacgagggtgaaacagcagacaaggagctaggggccctcctgaaaggagttgctggcaatgcccatgcacttcagactggcgattttagaaccccagctgagctggccttgaacaagttcgaaaaagagtctgggcacatcaggaatcagcggtcggactactcacatacatttagccgaaaggatctccaagcggaactgattttactgttcgagaaacagaaggaatttggaaacccccacgtgagtggtggcctcaaggaggggatcgagacccttctgatgactcagcgccctgccttgtccggagacgcagtccagaaaatgctaggccactgcacattcgaaccagctgagcccaaggccgctaaaaatacctatacggccgaaagatttatttggctgactaagctcaacaatctgaggatccttgagcaaggttctgaacggcctctgaccgatacagagcgcgcaactttgatggacgagccatacagaaaaagcaagctcacctatgcccaggctaggaaactgttagggctggaagatacagcgttctttaagggactacgttacggcaaggacaacgcagaggcctccaccctcatggaaatgaaggcttatcatgccatatcacgggcactggagaaagaaggccttaaagacaagaaaagtccgttgaatctgagccccgagctccaggatgagattgggacggccttctctctgtttaagactgacgaagatatcacaggacgacttaaggacaggattcagcctgagatcctggaggctttgctcaaacacatctccttcgataagttcgtgcaaatttcactgaaagccttaagacgcatagtaccactgatggaacagggtaagcggtacgacgaggcatgtgcggaaatctacggcgatcattatgggaaaaagaacaccgaggaaaagatttacctaccccctatcccagctgacgagataagaaaccccgttgtgctcagggccctgagccaggcacgcaaagtcattaatggagtggtgcgacggtatggcagtccggcccgtatccacatcgaaactgctagagaggtcggtaagtcttttaaagataggaaggagattgaaaaacgccaagaggaaaaccggaaggacagagagaaggccgcagctaaattcagggaatactttcctaatttcgttggggagcccaagtccaaagatatccttaagttgcgactgtatgagcagcagcacggcaaatgcctctacagcggaaaggaaattaacctgggccgcttaaatgagaaagggtatgtggaaatagaccatgccctgccattttcgcggacatgggacgattctttcaacaataaggtacttgtgttgggatccgagaaccagaataagggtaaccaaaccccttacgaatactttaatggcaaagacaactcaagagagtggcaggagttcaaggcgagggtcgaaacgagtcgttttccccgcagcaaaaagcagcggatcctcctgcagaaattcgatgaggacgggtttaaggaaagaaatctaaacgataccaggtatgtgaatcgattcctgtgtcaatttgttgccgaccggatgcgcctcacaggaaagggcaaaaagagagtgttcgcttccaacggtcagattactaacctgcttagggggttctggggcttgcggaaagtccgagcagagaatgatagacaccatgccctggacgctgtggtagttgcctgctctaccgtggcaatgcagcagaagatcacacgctttgtcaggtacaaagagatgaacgcgttcgatggaaagactatcgacaaggaaaccggcgaggtgttacaccagaaaacacattttccacagccctgggagttctttgcccaggaagtcatgattcgtgtgttcgggaagcctgatggaaaaccagaatttgaggaggctgacaccctcgaaaagctgcggactcttctggccgagaaattgagctcaagaccggaagcagttcacgagtatgtgacgcccctcttcgtaagtagggctcctaatcgcaagatgtccggtcagggccacatggaaacagtcaagagcgccaaacgactggatgagggggtgtctgttctaagagtgccactgacccaactcaagctgaaagaccttgagaagatggtcaaccgggaaagggagcccaaattgtacgaagcactgaaggcccgcttagaggctcataaagacgatcctgcgaaggcctttgcagaaccattctataagtacgacaaagctggaaatcgtactcaacaggtgaaggccgtaagagtggagcaagttcagaaaaccggcgtctgggtgcggaaccacaatggtatagccgataacgctacaatggtgagggtcgacgtttttgagaagggggataaatattacctcgtgcccatctactcatggcaagtggcaaagggcattctgccggaccgcgccgtagtccagggaaaggatgaagaggactggcagcttatcgatgacagtttcaattttaaattcagcctgcatcctaacgatctagtggaagttattaccaagaaagcgcgaatgttcggctattttgcttcctgtcacagagggactggaaatatcaacatacggatccacgacctcgatcataagattggcaaaaatggtatcctggaggggattggagtgaagacagccttgtctttccagaagtaccagatcgacgagctgggcaaagaaataaggccatgccgcttaaagaaaagaccccctgtcaggtga

SEQ ID NO: 2547 - RNA, 4005 nt, synthetic construct
  misc_feature 1..4005: note = Cas9 variant
  source 1..4005: mol_type = other RNA
atgaagaaaccctacaccatcggcctggacattgggacaaacagcgtgggatgggccgtcctcactgatcagtatgaccttgttaagagaaaaatgaagatagctggtgattccgagaaaaagcaaatcaagaaaaatttctggggcgtgaggctgtttgacgaagggcagacggcagccgatcggcgcatggcgcgaaccgctcgtagaaggattgagcggcgcagaaacaggatctcttacttgcagggaattttcgccgaagagatgtcaaagacagacgcaaactttttctgccggttaagtgatagcttttatgtagacaacgaaaaacgcaattcccgacaccctttctttgccactatcgaggaggaagtggagtaccataagaactatccaaccatataccacctgagagaggagctagtcaattcttcggagaaagctgatctcaggctggtgtatcttgcactggcccatatcattaagtaccggggcaacttcttgatcgaaggtgctctcgacacacagaatacctcagttgatgggatttacaagcaatttatccagacttataaccaggtgttcgccagcggaatagaggacggcagtctgaaaaagctggaagataataaagacgtcgcgaagattctcgtggagaaagtaacacgtaaggaaaaattagagcgcatcctgaaactttacccgggcgagaagtccgcagggatgtttgcccagttcatttctttgatcgttggaagcaaaggtaactttcaaaagcccttcgacctgatcgaaaaatccgatattgagtgtgctaaggactcatatgaagaggatctagaaagtctcctggcccttataggcgacgagtacgcagagctgttcgtggctgccaaaaatgcgtatagcgccgtcgtgttgtcttccatcattaccgtggcagaaacggagactaacgctaagctctcagccagcatgatcgaaagatttgatacccacgaggaagacctgggggagttaaaggctttcataaaactgcatctccctaagcactacgaggaaatttttagtaatacagagaaacacggatatgccggctacatcgatggtaagactaaacaggcagacttctacaagtatatgaagatgacccttgaaaacatcgagggggccgattactttattgctaaaatcgagaaggaaaacttcctgaggaaacagcggacatttgacaatggagcgattccacatcagttgcacctagaggaactggaggcaatactccatcaacaggccaagtattaccccttcctgaaagaaaactatgataagatcaagtctcttgtcacctttcgcattccttacttcgttggcccactggctaatggccagtccgaatttgcctggttgacgcgaaaggcagacggggagatcagaccctggaatatcgaagagaaggtggacttcggaaaaagcgccgtagattttattgaaaagatgactaataaagacacatatctccctaaggagaacgtgctgccaaaacactcgttatgctaccaaaagtacctggtctataatgaactaaccaaggtgaggtacataaacgatcagggtaaaacttcttatttctccggccaggagaaggagcagatcttcaatgacctctttaaacaaaagcggaaagttaagaagaaagatctggaacttttcttgcgcaacatgtcacacgtggagagtccgacaattgaagggctggaggacagctttaattcctcttacagcacctatcatgatctcctgaaggtcggaatcaaacaggaaattcttgacaaccccgtgaatacggagatgctggagaacatcgtaaagatattgaccgttttcgaagataaaagaatgatcaaggagcagctccagcaattttcagacgtgctggatggcgtcgtgttaaagaaactggaaaggcgtcactacacaggttgggggcggctaagtgctaagctcctgatgggcattcgagacaaacagtcccatcttactatcttggattatctgatgaatgacgacggactcaacagaaacctgatgcagttaattaatgatagcaacctgtctttcaagtcaatcatagagaaagagcaggtcaccacagccgacaaggatattcaaagtatcgtggcagaccttgcgggcagccctgctattaagaaagggatcttgcagtccctcaagatagttgatgaactggtgtctgtaatgggatacccaccccagactatcgtcgtggagatggccagggaaaatcagaccacaggtaaaggcaagaacaattcgcgccctcggtacaaaagcctagagaaggcaattaaagaatttgggtcccaaatcctgaaggagcacccaaccgacaaccaggagctcagaaataacaggctgtatctttactatttgcagaatggaaaggatatgtacactggccaagacctggatattcataacttatcaaattatgacatcgatcacatagttccccagagtttcattacggacaactctatcgataatctcgtgctgacaagctccgccggtaaccgcgaaaaaggggacgacgtcccgcctcttgagatcgtgcgaaagcggaaagtattttgggaaaagctgtaccagggcaatttgatgtcaaaacgtaagttcgattatctcaccaaggctgagagaggaggcctgactgaagccgacaaagcaaggtttattcaccgccagctagtggagacccggcaaatcacaaagaacgttgctaacattctgcatcagagattcaattacgagaaagatgaccacgggaacaccatgaagcaggtcaggatagtgactctcaaaagcgccctggtgtctcagtttcgaaagcaattccagctttacaaggtccgcgatgttaatgactatcatcacgcgcacgatgcctacttgaacggagtggtggctaatacactgttaaaagtatatccccagctcgaaccagagttcgtctacggtgactatcatcagtttgattggttcaaggcaaacaaagccacggctaagaaacaattttacaccaatatcatgctgttctttgcccagaaggaccggattatcgatgaaaacggcgagattctttgggacaagaaatatctggacactgtgaagaaagttatgtcctacagacagatgaatatcgtgaagaaaacagaaatacaaaagggggagttcagtaaggcaaccatcaaacctaagggaaacagctctaaactaattcccaggaagacaaattgggatccaatgaaatacggcggtctcgactcccccaacatggcgtatgccgtcgtgatcgagtacgctaaggggaaaaataagctggtttttgaaaagaaaattatccgtgtgactataatggagcgcaaggccttcgaaaaagatgagaaggcatttttggaggaacagggctatcggcagcctaaagtactggctaagttaccaaagtacaccctctatgagtgtgaagagggaagaaggcgaatgctggcctcagcaaacgaagcccagaaaggcaatcaacaggtccttccgaaccacctggtgacgttgctccatcacgctgcgaactgcgaggtgagtgacggaaagagcctggattacattgagtcgaatcgggaaatgttcgccgagctactggcacatgtctccgaatttgctaaacgctatacccttgccgaggccaacctcaataagatcaaccagctgttcgaacagaataaagagggggacatcaaggctattgcacaatctttcgttgatttgatggcctttaacgcgatgggcgctcccgccagcttcaagtttttcgagacaactatagaaagaaaaaggtacaataacctgaaggagttactcaattcaaccatcatttaccagagtatcacaggtctgtatgaatcccggaaacgacttgacgattga

SEQ ID NO: 2548 - RNA, 4038 nt, synthetic construct
  misc_feature 1..4038: note = Cas9 variant
  source 1..4038: mol_type = other RNA
atgaagaaaccctacagcatcggcctggacattgggaccaactccgtgggatgggccgtcgttacagatgactataaggtgcctgctaaaaagatgaaagtactcggtaatactgataagtctcacatagagaagaaccttctgggcgcattgttattcgactcagggaatacggccgaagatagaaggctgaaacggaccgcgcgccgacgttacacaagaaggcggaaccgcatcctatatctccaggagatttttagtgaagagatgggaaaggtggacgatagcttctttcatagactggaagactccttccttgtcactgaggataaaaggggcgagcggcacccaatctttggtaatctggaagaggaagtgaagtaccatgagaacttcccgaccatttatcacttgcgccaatacctcgctgacaatcccgagaaagttgatctgcgactggtgtatctcgccttagcacatatcataaagtttagagggcacttcctgatcgaaggaaagtttgacacaaggaacaatgatgtccagcggcttttccaggagtttttggccgtgtacgacaacaccttcgaaaattcttcgctgcaggagcaaaacgtacaggttgaagagattctaactgacaaaatctcaaagagcgctaaaaaggatcgtgtgctcaaactgtttcctaatgagaagagtaacggccgcttcgcagagttccttaaactgattgtcggcaatcaggccgactttaagaagcacttcgagttggaagagaaagctccactccagttttccaaggatacatacgaagaggagctggaagtgttactggcccaaatcggggacaactatgcggaactcttcctttctgccaaaaagctgtacgatagcatattgctatccggtattctgaccgtgacggacgtcggaactaaagcacccctctcagctagtatgatccagagatataacgaacatcagatggatctggcccagcttaagcaatttattaggcagaagctgagcgacaaatacaatgaggttttctctgatgtgtccaaggacggctatgcagggtacatcgatggaaaaaccaaccaggaagcattttataagtacttgaaaggcctcctgaataagatcgagggttcagggtacttcttagacaagattgagcgggaagactttctgcgaaaacaacgcacattcgataacggaagcatacctcaccagatccatctacaggagatgagagccattatcaggcggcaggcggaattttatccattcctcgccgacaatcaagatcgcatagagaagctgcttacttttaggattccctactatgtaggccctttggcaagaggcaaaagtgacttcgcttggctgtctcgtaagtccgccgataaaatcaccccatggaacttcgacgagatcgtggataaggaaagctcggctgaggcctttattaatcggatgacaaactacgacctctatctgccgaatcagaaggtccttcccaaacactctctgttgtacgaaaagttcaccgtgtataacgagctcacgaaagttaagtacaaaactgaacaggggaagacagcatttttcgatgccaatatgaaacaggagatctttgacggagtgttcaaggtctaccgaaaggtgaccaaagataagctgatggactttttagagaaagagttcgatgaatttagaattgtagacctgactggtctagacaaggaaaacaaagttttcaatgcttcctatggcacataccacgatctctgcaagatactggacaaggattttcttgacaacagtaaaaatgagaagatcttggaagatattgtgctgaccctcacgctgttcgaggacagggagatgatccgcaaacggttagaaaactattcagatctgcttaccaaggagcaagtcaaaaagttggaaagaaggcattacacagggtggggacgcctcagcgcggagctgatccacggcattcgaaacaaggaatcccggaaaactatactagactatctgatcgatgacggtaattctaaccgtaattttatgcagctcattaacgatgacgcactgagcttcaaggaggagatcgccaaagctcaggtgattggggaaaccgataatcttaaccaggtcgtgtcagacatcgccggcagtcctgcaataaagaaaggaatcttgcaatccctgaagattgttgacgagttagtgaagatcatgggccatcagccagaaaatattgtagtcgagatggccagagagaaccagttcacaaatcaggggaggcgcaacagccaacagcggctcaaaggactgactgattctatcaaggaatttggttcacagatacttaaagagcaccccgtggaaaatagtcaactgcagaacgacagattgttcctctactatctgcagaatggcagggatatgtacaccggggaggaactagacattgattacctgagccagtatgacatcgatcatattatccctcaggcttttataaaggacaactccatcgataatcgagttctcacatcttcgaaagagaaccgcggaaagagcgacgatgtgccatccaaagacgtcgtgcggaagatgaagtcatactggagtaaactgctttctgccaagttgattacccaaagaaaattcgacaacctgactaaggcagagaggggcggtttaacggatgacgataaagcggggtttatcaagcgtcagctcgtagaaacacgccagattaccaagcacgtggctcggatcctggacgagagattcaatactgaaaccgatgagaacaataaaaagataaggcaagttaaaattgtcacacttaagagcaacctggtgtccaattttcgaaaagagttcgaactatataaggtgcgggagatcaacgactaccaccatgcccacgatgcatatctcaatgccgtcatcggcaaggctctgttgggagtttacccccagctggaaccggagtttgtgtatggcgactaccctcatttccacgggcacaaagaaaacaaggccaccgctaaaaagtttttctactcaaatattatgaacttctttaaaaaggatgacgtgcgcactgataagaatggagagatcatttggaaaaaggacgaacatataagcaacatcaaaaaggtattatcttatccccaggtcaatattgtgaaaaaggttgaggagcagacaggtggcttctccaaggaaagtatcctcccaaaagggaacagcgataagctgattcctagaaaaacgaagaaattttactgggacaccaagaaatatggaggcttcgactctcccatcgtggcttactccatacttgtcatcgccgatattgagaagggtaagagtaaaaagctgaaaactgtgaaggcgttggttggggtgacaatcatggagaaaatgacctttgaaagggacccagtagccttcctcgagcggaagggctatcgaaatgtccaagaagagaacattatcaagctgcccaaatactcactatttaagctggaaaacggaagaaaacgccttctcgctagcgcaagggagctgcagaagggcaatgaaatagtgttgcctaaccacctggggacattactctatcatgccaaaaatattcacaaggtggatgagccaaagcatctggactacgtcgataaacacaaggacgagttcaaagaacttctggatgttgtgtcgaacttttccaagaaatacactttggctgagggaaatctcgaaaagatcaaggagctgtatgcccagaacaatggcgaagacctaaaagagctggcatctagcttcatcaaccttctcacctttacggcgattggtgccccggctaccttcaagtttttcgataaaaatatagaccgtaagcggtacacatcaactaccgagatcctgaacgccacattgattcaccaaagtatcactgggttatatgaaaccagaattgatctgaataaactcggaggcgactga

SEQ ID NO: 2549 - RNA, 3171 nt, synthetic construct
  misc_feature 1..3171: note = Cas9 variant
  source 1..3171: mol_type = other RNA
atgcagaccacaaacctgagctacatcctcggccttgacctggggattgcctccgtgggatgggctgtcgttgagataaatgaaaacgaggatcccatcggtttgattgacgtgggcgtaagaatcttcgaaagggcagaggtgcctaagactggggaatctttagccctgtcacggcgcctagcgcgaagtacgcgtagactcattaggcggcgcgctcacagactgcttctggccaaaaggtttttgaagcgggagggaatcctcagcaccatagatctggagaaaggcctgccaaatcaagcatgggaactccgcgtcgccggtttagagcgaagactgtccgctatcgaatggggagcagtgcttttgcatctgattaagcacagggggtatctatctaaacggaagaacgagtcgcagacaaataacaaggagctcggcgccctgctttcaggcgttgctcagaatcatcagctgttgcaaagcgacgattaccgtactccggccgaactcgcgctgaaaaagttcgcaaaagaggaagggcacatccgcaaccagagaggagcctatacccatacatttaataggttagacctgctcgctgagcttaacctgttgttcgcccagcagcaccaatttggtaatccccactgcaaggaacatattcagcagtacatgaccgagctactgatgtggcagaaacctgcactcagtggcgaggctatcctgaagatgcttgggaagtgtactcacgaaaagaacgagttcaaggccgcgaaacatacatattccgccgaacggtttgtgtggctgaccaagttgaataacctccgaatactggaggatggagcagaacgcgctttaaatgaggaggaaagacaactgctaattaaccacccatacgagaaatctaagctcacgtatgcccaggtcaggaaactgcttggcttgagcgaacaggctatcttcaagcacctccggtactccaaggagaacgccgaatcagcaacttttatggagctcaaagcctggcatgctattcgcaaggcgctggagaatcaaggtcttaaagacacctggcaggatctggcaaagaaacccgacttgctcgatgaaatcgggacagccttcagtctgtacaagactgacgaggatatccagcagtatttaaccaacaaggtgcctaatagcgtaattaacgctctgctagtttctctcaattttgacaaattcatagaactgtcccttaagtcattgagaaaaatcctgccactcatggagcaaggaaagaggtacgaccaggcctgccgtgagatttatggccaccattacggcgaagcaaaccagaaaacaagccagctgttacccgccatccctgctcaagagatacggaatccagtggtcctgcgaacccttagtcaggccagaaaggtgattaacgcaatcatcaggcagtatgggtctccggcgcgcgtgcacattgaaacgggacgggagttgggtaagtcctttaaagaaagaagggagatccagaagcaacaggaggataatcgcactaaacgagaaagcgctgtccagaagttcaaagagctgttctcggacttttcttccgaacccaagtcaaaggatattctgaaattccggctatacgagcagcaacatggcaagtgtctgtatagtgggaaagaaataaacatccaccgtctcaatgagaagggatacgttgagattgaccacgccctgccttttagcagaacatgggatgactccttcaacaataaagtgcttgtattggcatctgaaaaccagaataagggcaaccagaccccatacgagtggctgcaaggtaaaatcaacagcgaaaggtggaagaattttgtggccttagtcctcgggtcacagtgcagtgctgccaagaaacagcgcctgcttactcaggtgatcgatgacaacaagttcattgatcggaatctgaacgacacaagatatatagcaaggtttttgtccaattacatccaagagaacctcctgctagttggcaaaaataagaaaaacgtgttcacccccaatggacagattacggctctgctccgaagccgctggggcctgatcaaggcccgggaaaacaataacagacatcacgcgcttgatgccattgtcgtggcttgtgcaaccccttctatgcagcagaagatcacaaggtttatacgtttcaaagaggtacatccatataagatcgagaatcgctacgaaatggttgaccaagagtcaggggaaattatcagtccccactttccggagccttgggcctatttccggcaggaggtgaacattagagtctttgacaatcaccccgatactgtgttgaaagaaatgctgccagacaggcctcaggctaaccatcagttcgtccaacccttattcgtgagccgagccccaacccggaagatgtccggacagggtcacatggagacaatcaaatctgcaaagcgcctcgcggaaggcatatcggttctgaggattccccttactcagctgaagcctaacctactcgagaatatggtgaacaaagaaagagagccagccctgtacgctgggttgaaggcccggctggcagagtttaatcaagatccggctaaagccttcgcaacccccttttataagcagggaggccagcaggtaaaagccatccgagtcgaacaagtgcagaaaagcggtgttttagtgagagagaacaatggggtcgctgacaacgcgtccattgtgcgcacagatgtattcatcaagaataacaaatttttcctcgtgcctatatacacctggcaggttgccaagggcatcctgccaaataaagcaattgtcgctcataagaacgaagacgagtgggaagagatggatgagggagccaaatttaagttctcactttttcccaatgacctggtggaattgaaaactaagaaggagtacttctttggctattacatcgggctcgatagggccacgggaaacattagtctgaaagaacacgacggtgagatctctaagggcaaagatggggtgtatcgtgtcggagttaagctagctctgagcttcgaaaaataccaggtggacgagcttggcaagaatcggcaaatatgcagacctcagcagaggcagccagtgcgctga

SEQ ID NO: 2550 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatagggatcgcaagcgtgggatgggccatggtcgagattgatgaagacgagaacccaatctgccttattgatctgggtgttagagtgtttgaaagggcggaggtaccgaaaaccggcgactccttggctatggcccggcgcttagcacgatctgtgcgtagactgacaaggcggcgcgcccacagactactcagggctcggcgcctgcttaagcgagaaggggtcctgcaggcagccgatttcgacgagaatggattgatcaaatcactccccaacactccttggcaactgagagctgccgcgctggataggaagctcacgccattagagtggagtgcagtgctgcttcatttgataaaacaccggggctatctgagccagcgtaagaatgaaggtgagaccgccgacaaggaactaggggctctcctgaaaggagttgccgataacgcacatgcccttcagacaggcgactttcgcactcccgctgagctggcgttgaataagttcgagaaagaatccggccacatcagaaaccagcgaggggattactctcataccttttcgcggaaggacctccaagccgagctgattttactgttcgaaaaacagaaggagtttggaaatcctcacgtgtcaggtggcctcaaggaagggatcgagacacttctgatgacccagcgaccagcattgagcggagatgctgtccagaaaatgctaggccactgtactttcgagcccgccgaacctaaggctgccaaaaacacatataccgcagagcgctttatttggctgacgaagctcaataacctgagaatccttgaacaaggtagtgagaggccactgactgacaccgaacgggccacattgatggacgagccgtaccgcaaatccaagctcacttatgctcaggcgagaaaactgttagggctggaggataccgcattctttaagggactaaggtacggcaaggacaatgccgaggcttctacactcatggaaatgaaagcctatcatgcaataagccgtgccctggaaaaggagggccttaaagataagaaatcccccttgaacctgtcacctgaactccaggacgagattgggaccgctttcagtctgtttaagacggatgaggacatcactggacggcttaaggataggattcagccagaaatcctggaggccttgctcaaacacatcagcttcgacaagttcgtgcaaatttctctgaaagcattaagaaggatagtacccctgatggaacagggtaagcgctacgatgaggcgtgcgctgagatctacggcgaccattatgggaaaaagaatacagaagagaagatttacctacctccaatccccgccgatgaaatacggaacccggttgtgctcagagcactgtcccaggccaggaaagtcattaacggagtggtgcgccgatatggctcacccgctcggatccacatcgagaccgcccgtgaagtcggtaagagctttaaagacagaaaggagattgagaaaaggcaagaagagaatcgcaaggaccgggaaaaggcagctgccaaattcagagagtactttcccaacttcgttggggaaccaaagagtaaagatatccttaagttgaggctgtatgagcagcagcacggcaaatgtctctactctggaaaggagattaatctgggccgattaaacgaaaaagggtatgtggagatagaccatgcgctgcctttttcccgcacttgggatgacagcttcaataacaaggtacttgtgttgggatcggaaaatcagaacaagggtaatcaaacaccctacgagtactttaacggcaaagataattctcgggaatggcaggagttcaaggccagagtcgagacctccaggtttccacgtagtaaaaagcagcgcatcctcctgcagaaattcgacgaagatgggtttaaggagcggaacctaaatgacacgagatatgtgaacaggttcctgtgccaatttgttgctgatcgaatgcggctcaccggaaagggcaaaaagcgcgtgttcgcatcaaatggtcagattacaaacctgcttagagggttctggggcttgaggaaagtccgggccgaaaacgaccgacaccatgctctggatgccgtggtagttgcatgtagcactgtggcgatgcagcagaagatcaccagatttgtccgctacaaagagatgaatgccttcgacggaaagacaatcgataaggagactggcgaagtgttacaccagaaaacccattttccccagccttgggagttctttgctcaggaagtcatgattagggtgttcgggaagccagacggaaaaccggagtttgaagaggccgacacacccgagaagctccgtaccctgcttgcagaaaaactgtcctctcggcctgaggctgttcacgaatatgtgactccattgttcgtaagcagagcccccaacaggaagatgtcaggtcagggccacatggagacggtcaagagtgcaaaacgcctcgatgaaggggtgtccgttctgcgagtgcctctaacacaactgaagctcaaagacctggagaagatggtcaatagagagcgggaaccaaaactttacgaggccttgaaggctaggctggaagcgcataaagatgaccccgccaaggcatttgctgagccgttctataagtacgataaagccggaaaccgcacccaacaggtgaaggccgtacgtgtggaacaagttcagaaaactggcgtctgggtgagaaatcacaacggtatagctgacaatgcaaccatggtgcgggtcgatgtttttgagaagggggacaaatattacttagtgcctatctacagctggcaagtggccaagggcattctcccagatagggcggtagtccagggaaaggacgaggaagattggcagctgatcgacgattctttcaactttaaattctcacttcatcccaatgacctggtggaggttattacaaagaaagctcgcatgttcggctattttgccagttgccaccgagggaccggaaacatcaatataagaatccacgacctagatcataagattggcaaaaacggtatcctcgaagggattggagtgaagactgcactgagcttccagaagtaccagatcgacgagttgggcaaagagatacggccttgtaggctgaagaaacgccctccagtcagatga

SEQ ID NO: 2551 - RNA, 3255 nt, synthetic construct
  misc_feature 1..3255: note = Cas9 variant
  source 1..3255: mol_type = other RNA
atgaagtaccacgtgggcatcgacgtcgggaccttcagcgttggactggccgctattgaggtggatgacgcaggtatgcccataaaaacactctcccttgtatctcatatccacgattcaggcctggaccctgatgaaattaagagtgccgtgactagattggcgagctccgggatcgctaggcggacgcgccgattatatcgtagaaaaaggcggcgcctgcagcaactagacaagtttattcagagacagggatggccagtcatcgagctcgaagattactctgacccgctgtatccctggaaagtgagggccgagcttgcagcctcgtacatagctgatgaaaaggagcggggcgagaagctgtcagttgcattgcgccatatcgcccgacacagaggttggaggaacccttatgctaaagtgagcagtctctacctgccagacgggccctccgatgccttcaaggcgattcgggaagagatcaaacgtgcatctggacagcctgtcccagaaaccgccacagtgggccaaatggtaactctgtgcgagctcggcaccttaaagctgcgcggggagggaggtgttcttagcgctagattgcagcagtccgactatgccagggaaattcaggagatctgtcggatgcaagaaataggccaggagctgtaccgaaaaattatcgatgtggtctttgcagctgaatcacccaaggggagtgccagctctcgcgtgggaaaggaccctctacagccaggcaaaaatagagcgctcaaggcctccgacgcattccagaggtaccggattgctgccctgatcggtaaccttcgcgtgagagtcgatggggagaaaaggatcctgtcagttgaggaaaagaatttggtgtttgaccatctcgtaaacctgacaccgaaaaaggagcccgaatgggtgaccattgctgagatattaggaatcgatcgtggccaactgattggcactgccacaatgaccgacgatggggaacgggcaggagcccgacctccaacgcacgacactaatagaagcatcgtcaacagtaggatagctcccctcgtggattggtggaaaaccgcgtctgcacttgagcagcacgccatggttaaggctctgtccaatgccgaggtggacgatttcgacagccctgaaggtgcaaaggtccaggcctttttcgctgatttggacgacgatgtgcatgccaaactagactcgctgcacctcccagtaggccgcgcagcgtattctgaggatacactggttcggcttactagaaggatgctgtccgacggggtggatttgtacaccgctcgcctccaagaatttggaattgagccctcatggacaccgcctacgccccgaatcggcgaaccagtcggtaaccctgccgtggaccgggtcctgaagaccgtgagtcgttggttagagagcgcaactaaaacatggggagcccccgagagagttatcattgaacatgtgagggagggcttcgtaaccgaaaagcgcgctcgggagatggatggagacatgagaaggcgagccgcacgcaatgctaaactgtttcaggagatgcaggaaaagctaaacgtccagggcaagccatcccgggccgatctctggagatatcaatctgtgcagaggcagaattgccagtgtgcgtactgcgggagccccatcactttctcaaacagtgagatggaccacattgttcctcgtgccggacaaggttccacaaatacccgcgaaaacctggtggctgtctgtcaccggtgcaatcagagcaaaggcaacacgccatttgcaatatgggccaagaacacctctatcgagggggtgtcagtaaaagaagctgtggagagaacaaggcattgggttactgataccggaatgcgaagtacagacttcaagaaattcactaaggccgtcgtggagcggtttcagcgcgcaaccatggatgaagagattgacgcgagaagcatggaatccgtggcctggatggctaatgagcttaggtctcgggtcgcccagcacttcgcatcgcatggcacaaccgttcgagtgtatagaggtagcttgactgctgaagcccgcagggcatccgggatctcaggcaagctgaaatttttcgacggagtgggcaagagtcgtctcgatcggagacaccatgccatcgacgctgcggtaattgcctttacgtctgattacgtcgcagagacactggctgtgaggagcaaccttaaacaatcccaggcccaccgccaggaggccccgcagtggcgagagttcaccgggaaggacgctgaacacagagcagcctggcgggtttggtgtcagaaaatggaaaagctgtcagcgttgctcactgaggatctgagggacgatcgcgtggtcgtgatgagcaatgttcgtttaagactgggaaacggttctgctcataaggaaaccataggcaaactatccaaggtgaaactcagtagccaactgtctgtatccgacatcgataaggcctcaagtgaggcactttggtgcgccttgacacgggagcccgggtttgaccctaaagaaggactgccagctaatcccgagaggcacattcgcgtcaacggcacccatgtgtatgcaggggataatatcggtctcttccctgtgagcgccggctcgattgcgctgcgaggaggctacgctgaattagggtcctcttttcaccacgccagagtctacaagatcactagcgggaaaaagccagcattcgccatgctgcgggtttatacaatagaccttttgccctacaggaaccaggatctcttttcagtggagctgaagccgcaaacgatgagtatgcgccaggctgagaaaaagctaagagacgccctggcaaccggcaatgctgaatatctcggttggctggtagtggacgatgagcttgtcgtggacacttccaaaatcgccacagatcaggttaaggcggtggaagccgagttggggaccattaggcggtggcgtgtcgacggattcttttctcctagcaaactgcgcttacgaccactccagatgtccaaggaaggcatcaagaaagagtcagcacccgagctgagcaagattatcgatagacctggttggcttcccgctgtgaacaaactgttcagtgacggcaatgttacagtggtcaggcgggattctttggggcgcgtaagactcgaatccactgcccatctgccagtgacctggaaggttcaatga

SEQ ID NO: 2552 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagtcgagaatcccaagacaggtgaatcacttgccctgcctcggcgcttggcgcgaagtgctcgtaaaagattagccaggcggaaggcacgcctgaaccacctaaaacatctcatcgccaatgagtttaagctgaactacgaagattatcagagcttcgacgagtcccttgctaaggcatacaaaggctctctgatttcgccatatgagttgagatttagggccctcaatgaactgctgtcaaagcaagatttcgctcgggttatcctccacatagccaaacgccgagggtacgacgatatcaagaacagcgacgataaagagaagggagcgattttaaaggcaatcaaacagaatgaagagaagctggccaactatcagagtgtgggcgagtacctttataaagaatactttcagaagttcaaagaaaattccaaggaatttactaacgtaagaaataaaaaggagtcttacgaaaggtgtattgctcagagcttcttgaaggacgagctgaaactaatctttaagaaacaacgggagttcggtttttccttctcaaagaaattcgaagaggaagtgctcagtgtcgccttttataagcgtgcactgaaggatttcagccatcttgtggggaactgctctttctttacggacgagaaacgcgctccgaagaatagtcccctggcctttatgttcgttgcgttgaccagaataattaacctcctgaataacctgaaaaacacagaaggaatcttatacactaaggatgacctcaatgcccttctgaacgaggtgttgaaaaatggcaccctaacatataagcagaccaagaaactgctcggcctgtcagacgattacgagtttaagggggaaaaaggaacttatttcattgagtttaagaaatacaaggagttcatcaaggcacttggtgagcacaacctgagccaggacgatttgaatgaaatcgctaaagacattacactcataaaggatgagatcaaactgaagaaagccttagctaagtatgacctgaaccaaaatcagattgatagtctatctaaactcgagtttaaggaccatctgaacatctccttcaaggcccttaaattggtcacccctctgatgctcgaaggcaagaaatacgatgaggcatgtaatgaactgaaccttaaggtggccataaatgaggacaaaaaggattttctgccagctttcaacgagacgtactataaggacgaagtaactaatcccgttgtgttgagggcgattaaagagtaccggaaggtcctcaacgcactgctgaaaaagtatgggaaagtgcacaagatcaatatcgaattagcccgagaggtgggaaagaaccacagccagcgcgctaaaattgaaaaggagcagaacgagaattacaaagccaagaaagacgcagaactagagtgcgaaaagctcggcctgaagatcaactcgaaaaatattcttaagttgagactgttcaaagagcaaaaggaattttgtgcctattctggtgagaaaataaagatctccgatctccaggacgagaaaatgctggaaattgatcatatctacccttattcaaggagtttcgacgatagctacatgaacaaggtcttagtttttaccaagcagaatcaagagaaactgaaccagacaccattcgaggcttttgggaatgactccgccaagtggcagaaaatcgaagtgcttgcaaagaacttgcccactaaaaagcagaagcggattctcgataaaaattacaaggacaaagaacaaaagaacttcaaagatcgcaatctgaacgacaccagatatatagcgaggctagtactgaattacacaaaggattatctcgactttctgcctctttctgatgacgagaacaccaagttgaatgacacgcagaaaggaagcaaggtgcacgtcgaggctaaatcaggcatgctgacttccgccttacgtcatacatggggcttctccgcaaaggatcggaacaaccacctccaccatgccatcgacgctgtgattatcgcctacgcaaataacagcattgttaaggctttttctgatttcaaaaaggaacaggagtcaaatagtgccgaactgtatgcgaaaaagatcagcgagcttgactacaaaaacaagcgaaaatttttcgagccattttccgggttcagacagaaggtgctggataagatagacgaaatcttcgtctctaaaccggagaggaagaaaccctcgggagccttgcacgaagagacctttcgcaaggaagaggagttctatcaaagctacggtggcaaagaaggggtgctcaaggctctggagctaggaaaaattcggaaggtaaatggcaagatcgttaaaaacggtgatatgtttagagtggacattttcaagcataaaaagactaataaattttacgcagtccctatctatacaatggatttcgccctgaaggtgctcccaaacaaggctgtcgccaggtccaaaaagggggaaataaaagactggattctgatggatgagaattacgaattttgcttctcactttataaggacagtttgatcctgattcagaccaaagatatgcaggagcccgagtttgtgtactataacgcattcacgtctagcaccgtttccttaatcgtgtcaaagcacgacaataagtttgaaacactcagcaaaaaccagaagatactgttcaaaaatgcgaacgagaaggaagtaatcgccaaatctattggcatccaaaatcttaaggtcttcgagaagtacattgtgtccgctctgggagaagttactaaagccgagtttcgccagcgagaggacttcaagaaatga

SEQ ID NO: 2553 - RNA, 3366 nt, synthetic construct
  misc_feature 1..3366: note = Cas9 variant
  source 1..3366: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttagccagaaggaagaaacatcggcgcgtgagactgaataggctatttgaggaatcaggcctcattactgacttcacgaagatcagtataaacctgaatccttaccagcttcgggtcaaaggtctgaccgatgagttgagcaacgaagaactctttatcgcgctgaagaatatggtgaagcaccgcgggatttcctatctggacgatgcttctgacgatggaaactcgtcagttggcgactacgcccagatcgtgaaagagaatagcaagcagctcgaaacaaaaactccaggccaaattcagttagagcgatatcagacctacgggcagctgagaggagatttcacagtcgaaaaggacggtaaaaagcataggcttatcaacgtgtttccgaccagtgcatatcggtccgaggccttgcgtatactgcaaactcagcaggagttcaatccccagattacagatgaatttatcaaccgctacctagagattctcaccggcaagagaaaatattaccacgggcctggaaatgaaaagtctaggacggactacggccggtatcgaactagcggtgagaccctggataacatcttcgggatccttattggaaaatgcacattttacccagacgagttccgcgctgcaaaggcctcctatactgctcaagagtttaacctgttgaatgacctcaacaatctgaccgtacccacagagaccaaaaagttatcaaaagaacagaagaaccagataatcaattacgttaagaacgagaaagccatgggccctgcgaagctgttcaaatatattgcaaagctccttagttgtgatgtggccgacatcaaaggctacagaatagataagagcgggaaggctgaaattcatacgtttgaggcctataggaaaatgaagactctggaaacattggacatcgagcaaatggatcgggagaccctagacaaactggcatacgtcctcactctgaatacagaacgcgagggaatccaggaagctcttgagcacgagttcgccgatggttctttctcccagaaacaggtggacgagctggtgcaatttagaaaagcgaactcaagcattttcggcaaggggtggcacaattttagtgtcaagttgatgatggagctcatcccagaactgtacgagacctctgaagaacagatgacgattttaaccaggctgggaaaacagaagacaacttccagctcgaacaaaaccaagtatatagatgagaaactactcacagaagagatctacaatcccgttgtggccaagtctgtacgtcaggcaattaagatcgtgaacgctgccatcaaagaatatggcgacttcgataatattgtcatagagatggctcgggaaactaacgaggacgacgagaagaaagccatccaaaagattcagaaagcaaataaggatgaaaaagacgccgctatgctgaaggcggcaaaccagtacaacggtaaggccgagcttcctcattccgtgtttcacgggcataaacagttggctaccaagatccgactgtggcaccaacagggcgaaagatgcctctatacaggaaaaaccatttcaatccacgatctgataaataacagtaatcagttcgaggttgaccatatccttccactgagcattacttttgatgactccttggccaacaaggtgctcgtctacgcaacggccaatcaggaaaaaggccaaaggacaccgtatcaggctctggattctatggacgatgcctggagcttccgcgagttaaaggcatttgtgcgggagtcaaagaccctgagtaacaaaaagaaagaatacctactcactgaggaagacatctccaagttcgatgtaaggaaaaagtttattgagagaaatctggttgacacccgctacgcgagccgagtggtccttaacgctttgcaggaacacttccgggcccataagatcgatacaaaagtgtctgtcgtgcgtgggcaatttacctcacagctgagaaggcactggggaatagagaagactcgcgacacatatcatcaccacgcagttgacgccctcattatcgctgccagtagccagctgaatttatggaaaaagcagaaaaacacgctggtgtcctactctgaggatcaacttttggacattgaaaccggtgagctcatctcggatgacgaatataaggagagcgtattcaaggcaccctaccagcatttcgtcgatactctgaaatccaaggagtttgaagactcaatactattcagttatcaggtggattctaaatttaatcggaagatcagcgacgctacaatttacgccaccagacaggcgaaagttggcaaggataaagccgacgagacatatgtgctggggaagatcaaggatatttacactcaagacggatacgatgctttcatgaaaatctataagaaagacaagtccaaatttctcatgtacaggcacgaccctcagaccttcgaaaaggtcatagagccaattctggaaaactatcccaataagcagatcaacgagaaaggcaaggaggtgccttgtaatccatttcttaaatacaaggaggaacatggttatatccgaaaatactcaaagaaggggaacggccccgaaattaagagcttgaagtattacgattctaaactgggaaaccacatcgacattacgccgaaggattccaataacaaagtagtgttacagagtgttagcccttggcgcgcagacgtctacttcaataagaccacaggcaagtatgagatactcgggctgaaatacgccgatcttcaatttgaaaagggaactggtacctataaaatctctcaggagaagtacaacgacattaaaaagaaggagggcgtggattccgactcagagttcaaatttacactgtataagaatgatttgctcctggtgaaagacactgaaaccaaggaacagcaactattccggtttctgagtagaacgatgcccaaacagaagcactacgtcgagctcaaaccatatgataagcagaagttcgaagggggagaggctctgatcaaagttcttggcaacgtggccaatagcggtcagtgcaagaaagggttgggcaagtcgaacatttccatctacaaagtgaggacagacgtactgggaaatcaacatataatcaagaacgagggcgacaagcctaaattagatttctga

SEQ ID NO: 2554 - RNA, 2556 nt, synthetic construct
  misc_feature 1..2556: note = Cas9 variant
  source 1..2556: mol_type = other RNA
atgaccaacggcaagatcctggggctcgacattggagtggccagcgtcggtgttggcataatcgaggctaaaacagggaaggtgattcacgcaaattccagacttttctctgccgcgaacgctgaaaataacgccgagaggcggggatttcgcggcgcacgacgtctgactagaaggaaaaagcatcgggtaaaacgcgtgagagatttgttcgaaaagtacgacatcttaacggattttaggaatctgaacctaaatccctatgagctccgggtcaagggtctgaccgaacagcttacaaacgaggagctgttcgccgctttgcgcactattgcaaaacgaagagggatctcatacctcgacgatgccgaagacgatagtaccggaagctccgactatgctaagtctatagatgagaataggcggctgctgaaatcgatgacacctggccaaatccagctcgaacgtttagagaagtacggccagctgcgcgggaactttaccgtgtatgacgagaatggagaagcccacagacttattaacgttttctcaactagcgattacaaaaatgaggcgaggaagatcttggaaacacagagtaactataataagcaaattaccgacgagtttatcgaagattacatagagattctgacgcagaaacggaagtactatcatggtccaggcaacgagaaatcccgaactgactacgggcgcttcagaaccgacggaacaactctagaaaacatctttggcattctcatcggtaagtgctctttctatccggaggaatacagggcaagcaaagcctcctataccgctcaggagtttaatttcctgaacgatcttaataacctgaaggtgcccacagaaaccgggaaattgtcaacggagcagaaggagtacctcgtcaattttgccaagaacagtaaaactctgggagcaagcaagttactgaaagaaatcgctaagctcgtggacggcgatgtaaaagacatttctggctatcgggaggattccaaggggaagcctgaccttcacacattcgaaccataccgcaaactgaagttcaatttgaccactgttgatatagacaacctatcaagagatatcctggacaaactcgccgatattctgacacttaataccgagagggaaggaatcgaggacgcgataaaccaaaatctgcccgagcagtttacgaaggaacagattagcgagatcgtgcagatccgtaaaagtcaatcttccgccttcaacaagggttggcatagcttttcggcaaagttgatgaatgaactcattcctgagctgtacgctacctctgaggaacagatgacaatcttaactcggctggagaaattcaaggccaccaaaaagtccagtaaaaacacaaagactattgacgaaaaggagataaccgatgaaatctataatccagtcgtggctaaatcagtgcgacagacaattaagatcatcaacgccgcagtcaaaaagtacggcgactttgataaaattgttatagagatgcccagagacaagaacgccgatgacgagaaaaagttcatcgataagaaaaataaggaaaacaaaaaggagaaagacgatagcctaaagagggctgcgtatctctacaatgggaccgacaagctgcctgatgacgtgtttcacggaaacaaacaacttgcaactaagattcgcttgtggtatcagcagggcgaacggtgtctgtactccggtaaaccaatcctcattcaggatctggtacacaattctaacaatttcgagatcgaccatatacttccgctgagcttgtcatttgacgatagtctcgccaacaaggtgctggtctatgcttgggccaatcaagaaaaagagcagaagacgccctaccaggtgatcgactccatggatgcagcctggagcttcagagagatgaaggactacgttttaaaacagaaggggattggcaaaaagaaaagggaatatctgctaacaaccgagaacatcgataagattgaagtgaagaaaaagtttatcgagcgcaatctcgtcgacactcgatacgcttctcgggtggtactgaactcacttcaaaccgccttgaaagaactgggaaaggatacaaaagttagtgtggtccgtggccagttcaccagccagctcagaaggaagtggaaaatagacaagtcccgcgagacttatcaccatcacgcagtggatgcgctgattatcgctgcctcttcgcagttaaagctgtggcaaaaacacgagaatcttatgtttgaaaactacggggagaatcaggtcgtgaacaaggaaacaggagagattttgagcatctccgacgatgagtataaagaatcagttttccagcctccataccagggtttcgtgaacacgataagttctaaggcatttgaggacgaaatcctcttcagctatcaagtagattccaaatttaatcggaaggtctcagacgccaccatttacagcactagaaaggctaaactgggcaaggacaaaaaggaggaaacatacgtgctagggaaatga

SEQ ID NO: 2555 - RNA, 2598 nt, synthetic construct
  misc_feature 1..2598: note = Cas9 variant
  source 1..2598: mol_type = other RNA
atgagacacaagatcggcctggacattgggataaccagcgtgggatgggccgtcatcaacctcgatattcccaggatcgaggaccttggtgttcggattttcgatcgcgctgaaaatcctcagacaggcgagtccctggcattgccacgacgtttagccagatctgcgaggcggcgcctgagaaggcggaaacatcgcctagaacgaatcagaaggctcctgatacgggaggggatccttactaaggaggaactggacaaattgtttgaggaaaagcacgagattgatgtgtggcaactccgtgtagaagctctggaccgcaaactgaacaatgatgagctcgccagagtgttactgcatcttgcaaagaggcggggattcaagtcaaaccgaaaaagtgagcgcaataacaaggaaaatagcacgatgttgaaacacatcgaggaaaacagagccctgctatccggctacaggaccgtcgctgagatgattgtgaaggacccgaaatttgcattccataagcggaataagggtgaaaactatacaaatactatcgcccgcgatgacctcgagagagagataaaactgatttttaccaagcagagggaatacgggaacatcgtttgcacagagaccttcgaaaatgagtatattatgatctgggcttctcagcgtccctttgcctcgaaaaacgatatcgaaaagaaagtgggattctgtacttttgagcctaaggagaaacgggcgccaaaggcaacatacaccttccagtcatttgtcgcctgggaacacattaataaacttcgactggtgtatcccacgggcactagaggcttgaccgacgaggaaaggcgcctcctgtacaaacaggctttccacaagaacaaaataacatatcatgatatccggactttactgcacctccctgacgacacctactttaaggggattgtatacgatagaggagccccacttaaacaaagcgagacaatcaggttcctggaattggacgcatatcatcagatacgcaaggctgttgataaggtgtacggtaaaggcaagagttcctctttcctacccattgactttgataccttcgggtatgccctgacgctctttaaagacgatgcggacatccgaagctacctgcggaacgagtatgagcagaatggaaagcgtatgcctaaccttgccaataaagtctacgataacgaaccaatcgaggaactgttgaatctctccttcactaagtttggccacctgtcattaaaggcactgagaaacattctaccgtatatggagcaaggtgaggtgtacagtgtggcttgcgaaagggccgggtacacattcaccggacccaaaaagaaacagaagactctcctgcttcctaatatcccacccattgctaaccctgtcgttatgcgcgccttgacacaggcacggaaagtggtaaatgccataatcaagaagtatggcagcccagtgtctattcacatcgagctggctagagacctctcccagacctttgatgaaaggcgaaaaacgaagcgcgagcaagacgaaaaccggaaaaagaatgagaccgcgatcagacagctgatggagtacggccttacaattaaccccactgggcatgacatagtcaaattcaagctgtggtcagaacagaatggaaggtgtgcatatagcttgcaaccgatcgagattgaacgtctcctggagcctggttacgtggaagttgatcacgtgatcccctatagtcgctctttagacgattcctacaccaacaaagtcctggtgctaacaaaggagaatcgggagaagggcaacaggattccagccgaatatctcggggtaggaactgagagatggcagcagtttaaaaccttcgttctgacaaacaagcagtttagcaaaaagaaacgagaccggcttttgcgcctgcattacgatgaaaatgaggaagctgagtggaagaacagaaatctcaacgacaccaggtacatctcgcggttctttgccaatttcatacgagagcacctgaagttcgcagaatctgatgacaaacaaaaggtgtatactgtcaacggcagagtgacggcccatttacgctccaggtgggattttaataaaaaccgtgaggaatcagacctgcaccacgctgtcgatgccgcaatcgtggcgtgcacaagtcctagcgacattgctcgggttaccgccttctaccagagaagggagcagtgtaaggagtccgcaaagaaggccgaaccccattttccacagccctggcctcacttcgctgatgagcttcgcgcccgattgtctaagaatccaaaagaaagcatcaaggcactcaacctgggtaattatgacgaccaaaaactagagtcactgcagccggtgtttgtaagtagaatgcccaagcggtccgtcactggggctgcccatcaggaaaccctcaggcgctacattggcatcgatgagcgtagcggaaaaatacagacagtggttaagaccaagctgtctgagattaaacttgacgaaactggccacttccctatgtatgggaaggagtcagatccacccgcgagtgcctga

SEQ ID NO: 2556 - RNA, 2886 nt, synthetic construct
  misc_feature 1..2886: note = Cas9 variant
  source 1..2886: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacaatggagacgaggaaaaaggcaagattttaaaggcaatcaaacagaacgaggagaagctggttaattatcagagcgtgggtgaatacctttataaagagtactttcagaagttcaaagaaaacagtaaggagtttattaatgtaagaaacaaaaaggaatcctacgagaggtgtatcactcaatctttcttgaagtatgagctgaaactaatatttcagaagcagcgggagttcgggtttagcttctccaaaaagttcgaagaagaggtgctctcagtcgccttttacaaacgtgctctgaaggatttcagtcatcttgtgggaaattgcagctttttctctgacgaaaagcgcgccccgaaaaactcacccctggcatttatgttcgttgctttgacgagaattatcaatctcctgaacaacttaaagaataccgagggcattctgtatacaaaagatgacctcaacgcccttctgaatgaggtgttgaagaacggcactctaacctacaaacagacaaagaagctgctcgggctgtccgatgactatgaatttaaaggagagaagggtacctacttcatcgaatttaaaaagtataaagagttcatcaaggcgcttggcgaacacaatctgagccaagacgatttgaacgagattgccaaggacataactctcatcaaagatgagattaagctgaaaaaggcattagctaaatacgacctgaatcagaaccagatcgatagtctatctaagctcgaatttaaagaccatctgaatatagggttcaaggcccttaagttgattacacctctgatgctcgagggaaagaagtacgatgaggcttgtaacgaactgaatcttaaagtcgccatcaacgaggacaagaaagattttctgccagcattcaatgaaacctattacaaggacgaggtgacgaaccccgtagttttgagggccatcaaggaatatcggaaagtgctcaatgctctgttaaagaaatacggcaaggtccacaaaattaacatcgagctggcgcgagaagtgggtaagaaccactcccagcgcgcaaagattgagaaagagcaaaatgaaaactataaggccaaaaaggatgctgagctagaatgcgagaaactcgggctgaagataaatagcaagaacatccttaaattgagactgttcaaggaacagaaagagttttgtgcctactcgggagagaagattaaactctctgacctgcaggacgaaaagatgttagagatcgatcatatctatccttactccaggtcattcgacgatagttacatgaataaagtgctggtctttactaagcaaaaccaggaaaaacttaataaaaccccattcgaggcatttggcaacgacaatgttaagtggcagaaaattgaagtgttggccaagaacctccccgagaaaaagcagaagcggatactggataaaaattataaggacaaagagcaaaaggatttcaaagaccgcaacctaaatgatacaagatacatcgctaggctggtactcaactatactaaggactacctggattttcttcctttgagcgacgatgaaaataccaagctgaaaggctccaaggtgcacgtcgaggccaaatctgggatgttaacaagcgcactccgtcatacctggggattctcaacgaaggaccggaacaaccatctgcaccacgcgattgacgctgccatcattgcatatgccaataacagtatcgtgaaagatttttccgacttcaagaaggaacaggagagcaattctgctgagctttacgccaaaaagatatcagaactggattataaaaacaagcgaaaatttttcgagccatttagtggtttcagacagaaggttttggacaagatcgatgaaattttcgtgagcaaaccggagaggaagaaaccctccggcgcactccacgaagagacttttcgcaaggaggaagagttctaccagtcttacgggggaaaagaaggcgtcctgaaggctctagagctgggtaaaatccggaaggtgaatgggaagattgttaaaaacggcgacatgtttagagtagatatcttcaagcataaaaagacaaataaattttatgccgtgcctatatacaccatggacttcgcgctcaaggtcctgccaaacaaggccgtggctaggtcgaaaaagggagaaattaaagattggatccttatggacgagaattatgagttttgcttcagcttgtacaaggattccctgattttaatccaaactaaagacatgcaggaacccgagctcgtctattttaacgcattcacatcaagtaccgtgtctctgatagttagcaagcacgataataagtttgaaacgctttccaaaaacctgaaggtgttcgagaaatacatcgtatcagccctaggcgaagtcaccaaggctgagttccgccagcgagaggactttaaaaatgaactccggtga

SEQ ID NO: 2557 - RNA, 2955 nt, synthetic construct
  misc_feature 1..2955: note = Cas9 variant
  source 1..2955: mol_type = other RNA
atggccaagatcctggctttcgacattggcataagctccatcgggtgggcattttctgagaacgatgaactcaaagactgcggagtgagaattttcaccaaggccgagaatcccaaaacaggtgaatcacttgcgctgcctaggcggatcgctcgcagtgcccgaaagcgtttggcaagaaggaaagcccggttaaaccacctgaagcatctaattgctaatgagtttaagctcaactacgaagattatcagagcttcgacgagatcctggcaaaagcctacaagggctcccttatatctccatatgagctgcgctttagagctttgaatgaactcctgtcgaaacaagatttcgccagggtcatcctgcacattgcgaagcggcgcgggtacgacgatatcaaaaacaatggagacgaggaaaagggcaagattctcaaagcaatcaagcagaacgaggagaaattagccaattatcagtcagttggtgaatacctgtataaggagtactttcagaaattcaaggaaaacagcaaagagtttataaatgtgcgaaacaagaaggaaagttacgagagatgtattgctcaatccttccttaaagatgagttgaagctgatctttaaaaagcagagggaatttgggttttctttcagcaaaaagttcgaggaagaggtactatccgtggccttttataagcgggcactcaaagacttctcacatctggtcggaaattgcagtttcttcactgatgaaaagcgtgctccgaaaaacagcccccttgcctttatgttcgtggcgctgacgcgcattatcaatttgctcaacaacctgaagaataccttatacacaaaagacgatctgaacgccctccttaatgaggttctgaagaacggcactttgacctataagcagacaaagaagctactgggcctctctgacgactacgagtttaaaggggaaaagggaaattatttcatcgagtttaaaaagtacaaggagttcattaaagcactgggtgaacactccctttcacaggatgacctgaacgaaatagctaaggatatcaccttgattaaagacgagatcaagctcaaaaaggccctggctaaatatgatttaaatgagaaccaaatagacaatctgagcaagctagaatttaaggatcatctcaacattagtttcaaagccctgaaacttatcactcctttgatgctggagggcaaaaagtacgacgaagcatgtaatgagctcacactgaaagtggccatcaacgaggataagaaggactttcttccagctttcaatgaaacctactataaagatgaggtcacgaaccccgtggtactgagagcgattaaggaatacaggaaagttttgaatgcactcctgaagaaatatgggaaggtgcacaagatcaacattgagttagcccgggaagtcggcaaaaaccactctcagcgagctaagatagagaaagagcagaatgaaaactacaaggccaaaaaggacgcagagctggaatgcgagaagctaggactcaaaatcaattccaagaacattctgaaacttcgcttgttcaaggaacagaaagagttttgtgtgtatagcggtgagaagatcaaactgtcggacctccaagatgaaaagatgctggagatcgaccatatttacccttattctagatccttcgatgactcatacatgaataaggtgttagtctttactaaacagaaccaggaaaagctgaatcaaaccccattcgaggcctttgggaacgatagtgctaaatggcagaagatagaagttcttgccaaaaatttgcccacaaagaagcagaaaaggatcctcgacaagaactacaaagataaggagcagaaagacttcaaggatcggaatctgaacgacactcgctatattgcaaggctagtgctgaattacaccaaggattatctcgactttctgcctcttagcgatgacgagaacacaaaattgaatgacacccaaaagggatccaaagtacacgtggaagcgaagtctggcatgctgacgagcgctttaagacatacttggggcttctcaacaaaagatcgtaacaaccacctccaccatgccatcgacgcagtcattatcgcctacgctaataacagtatagtgaaggccttttccgatttcaagaaagagcaggaaagcaataccgcagagctgtatgctaagaaaatctctgagcttgactacaagaacaaacggaagtttttcgaaccattttcagggttccgacagaaggttctggataaaattgacgagatcttcgtgagtaagccggaaaggaaaaagcccagcggagccttgcacgaggaaacttttagaaaagaggaggagttctatcagtcctacggtggcaaggaaggggtcctcaaagcgctggaactaggaaagattcgcaaggtgaatggcaaaatcgtaaagaacggtgatatgtttcgggttgacatattcaaacataagaaaacaaataagttttacgccgtgcctatttataccatggatttcgctctgaaggtcctcccaaacaaagcagtggccagatctaagaaaggggagatcaaggactggattctgatggatgaaaattacgagttttgcttctcgctttataaagacagcttgatcctgatacaaacgaaggatatgcaggagcccgaatttgtctactataacgctttcacctcctcaacagtgagtttaatcgtttctaagcacgacaataaatttgagactctcagcaagaaccagaaaattctgttcaagaatgccaacgaaaaagaggtgatcgcaaagtccattggcatccagaatcttaaggtattcgaaaaatacatagtctcagcgctgggagaggtgaccaaggccgagtttaggcaacgcgaagagttcaaaaacgaactacgatga

SEQ ID NO: 2558 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaacagactaaaacacctcatcgctaatgagtttaagctgaactacgaagattatcagagcttcgacgagtcccttgcaaaggcctacaaaggctctctgatttcgccatatgagttgaggtttcgggctctcaatgaactgctgtcaaagcaagatttcgcccgcgtcatcctccatatagcgaaacgaagagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgaggaataaaaaggagtcttacgaacggtgtattgcccaaagtttcttgaaggacgagctgaaactaatctttaagaaacagcgtgagttcggtttttccttctcaaagaaattcgaagaggaagtactcagtgtggcattttataagcgcgctctgaaggatttcagccaccttgtcgggaactgctcctttttcacggacgagaaaagagccccgaaaaattctcccctggcgtttatgttcgtggccttgaccaggataattaacctcctgaataacctgaaaaacacagaaggaatcttatacactaaggatgacctcaatgcacttctgaacgagtttttgaaaaatggcaccctaacatataagcagaccaagaaactgctcggcctgtcagacgattacgagttcaagggggaaaaaggaacttattttattgagttcaagaaatacaaggaatttatcaaggctcttggtgagcataacctgagccaggacgatttgaatgaaatcgccaaagacattacactcataaaggatgagatcaaactgaagaaggctttagccaagtatgacctgaaccaaaatcagattgatagtctatctaaactcgagttcaaggaccacctgaacatctcctttaaggcacttaaattgataacccctctgatgctcgaaggcaagaaatacgatgaggcctgtaatgaactgaaccttaaggttgctattaatgaggacaaaaaggatttcctgccagcgttcaacgagacgtactataaggacgaagtgactaatcccgtcgtgttgcgggcaatcaaagagtaccgaaaggtactcaacgccctgctgaaaaagtatgggaaagttcataagatcaatattgaattagctcgcgaggtgggaaagaactacagccagagagccaaaatcgaaaaggagcagaacgagaattataaagcaaagaaagacgccgaactagagtgcgaaaagctcggcctgaagattaactcgaaaaatatacttaagttgaggctgtttaaagagcaaaaggagttctgtgcttactctggtgagaaaatcaagatttccgatctccaggacgagaaaatgctggaaatcgatcacatctatccttactcacggagttttgacgatagctacatgaacaaggtcttagtgttcaccaagcagaatcaagagaaactgaaccagacaccatttgaagccttcgggaatgactccgcaaagtggcagaaaattgaggtgcttgcgaagaacttgcccactaaaaagcagaagcgcatactcgataaaaattataaggacaaagaacaaaaggattttaaagacagaaacctgaatgataccaggtacatcgctcgtctagtcctgaactatacaaaggactacctcgatttcctgcctctttctgacgacgagaataccaagttgaacgatacgcacaaaggaagcaaggttcatgtggaggccaaatcaggcatgctgactagcgcattacggcacacatggggcttttccaccaaggaccgaaataaccatctcagacacgccattgatgctgtaatcattgcctatgcaaacaatagcatcgtgaaggctttctctgactttaaaaaggaacaggagtcaaacagtgccgaactgtacgcgaaaaagataagcgagcttgattataaaaataagaggaaattctttgagccattctccgggttccgccagaaggtcctggacaagatcgatgaaatttttgtgtctaaaccggagcggaagaaaccctcgggagccttgcacgaagagactttcagaaaggaagaggagttttaccagagctacggtggcaaagaaggggttctcaaggctctggagctaggaaaaatcaggaaggtgaacggcaagattgtcaaaaatggtgacatgttccgcgtggatatctttaagcataaaaagacaaacaaattctatgcagtacctatatacaccatggactttgccctgaaggttctcccaaataaggctgtggcccgatccaaaaagggggaaattaaagattggatcctgatggacgagaactatgagttctgcttttcactttacaaggatagtttgattctgatccaaacgaaagacatgcaggaacccgagttcgtctattacaatgcatttacctctagcacagtgtccttaatagtctcaaagcacgacaacaagttcgaaactctcagcaaaaatcagaagatcctgttcaaaaacgcgaatgagaaggaagtgattgccaaatctatcggcattcagaaccttaaggtttttgagaagtatatcgtgtccgctctgggagaagtaaccaaagccgagttccggcaacgtgaggattttaagaaatga

SEQ ID NO: 2559 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagtcgagaatcccaagacaggtgaatcacttgccctgcctcggcgcttggcgcgaagtgctcgtaaaagattagccaggcggaaggcacgcctgaaccacctaaaacatctcatcgccaatgagtttaagctgaactacgaagattatcagagcttcgacgagtcccttgctaaggcatacaaaggctctctgatttcgccatatgagttgagatttagggccctcaatgaactgctgtcaaagcaagatttcgctcgggttatcctccacatagccaaacgccgagggtacgacgatatcaagaacagcgacgataaagagaagggagcgattttaaaggcaatcaaacagaatgaagagaagctggccaactatcagagtgtgggcgagtacctttataaagaatactttcagaagttcaaagaaaattccaaggaatttactaacgtaagaaataaaaaggagtcttacgaaaggtgtattgctcaatctttcttgaaggacgagctgaaactaatctttaagaaacagcgggagttcggtttttccttctcaaagaaattcgaagaggaagtgctcagtgtcgccttttataagcgtgcactgaaggatttcagccatcttgtggggaactgcagctttttcacggacgagaaacgcgctccgaaaaattcccccttagcctttatgttcgttaccttgacaagaataattaacctcctgaataacctgaaaaacactgaaggaatcctgtacaccaaggatgacctcaatgcgcttctgaacgaggtgttgaaaaatggcacactaacctataagcagactaagaaactgctcggcctgtcagacgattacgagtttaagggggaaaaaggaacatatttcattgagtttaagaaatacaaggagttcatcaaggcccttggtgagcacaacctgagccaggacgatttgaatgaaatcgcaaaagacattaccctcataaaggatgagatcaaactgaagaaggctttagccaagtatgacctgaaccaaaatcagattgatagtctatctaaactcgagtttaaggaccatctgaacatctccttcaaggctcttaaattgataacgcctctgatgctcgaaggcaagaaatacgatgaggcctgtaatgaactgaaccttaaggtcgcaattaatgaggacaaaaaggattttctgccagccttcaacgagacttactataaggacgaagtgaccaatcccgtagttttgagggctatcaaagagtaccggaaggtgctcaacgcgctgctgaaaaagtatgggaaagtccacaagatcaatattgaattagcacgagaggtgggaaagaaccacagccagcgcgccaaaatcgaaaaggagcagaacgagaattacaaagctaagaaagacgccgaactagagtgcgaaaagctcggcctgaagattaactcgaaaaatatacttaagttgagactgttcaaagagcaaaaggaattttgtgcatattctggtgagaaaatcaagatttccgatctccaggacgagaaaatgctggaaatcgatcatatctacccttattcaaggagtttcgacgatagctacatgaacaaggtgttagtctttacaaagcagaatcaagagaaactgaacaagactccattcgaagcctttgggaatgactccgctaaatggcagaagattgaggttcttgccaaaaacttgcccaccaagaagcagaaacggatactcgataagaattacaaagacaaggaacagaaagatttcaaggaccgcaacctgaatgatacaagatatatcgcaaggctagtgctgaactacaccaaggactatctcgattttctgcctctttctgacgacgagaatacgaaattgaacgatactcaaaagggaagcaaagtacacgtggaggcgaagtcaggcatgctgacaagtgctttacgtcatacctggggcttctccactaaagaccggaataaccacctccaccatgccattgatgcagtcatcattgcctacgctaacaatagcatcgtgaaggccttttctgacttcaagaaagaacaggagtcaaacagtgcagaactgtatgctaagaaaataagcgagcttgattacaagaataaacgaaagtttttcgagccattttccgggttcagacagaaggttctggacaaaatcgatgaaattttcgtgtctaagccggagaggaaaaagccctcgggagccttgcacgaagagacatttcgcaaagaagaggagttctatcagagctacggtggcaaggaaggggtcctcaaagcgctggagctaggaaagatccggaaggtgaacggcaaaattgtaaagaatggtgacatgtttagagttgatatcttcaaacataagaaaaccaacaagttttacgccgtgcctatatatacgatggacttcgctctgaaggtcctcccaaataaagcagtggccaggtccaagaaaggggaaattaaggattggatcctgatggacgagaactacgaattttgcttctcactttataaagatagtttgattctgatccaaaccaaggacatgcaggagcccgagtttgtctactataatgctttcacatctagcactgtgtccttaatagtttcaaagcacgacaacaaatttgaaaccctcagcaagaatcagaaaatcctgttcaagaacgccaatgagaaagaagtgattgcaaagtctatcggcattcagaaccttaaggtattcgagaaatacatcgtctccgcgctgggagaagtgacaaaggccgagtttcgccaacgagaggatttcaaaaagtga

SEQ ID NO: 2560 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccaatccttcttgaaggacgagctgaaactaatctttaagaaacagcgggagttcggtttttccttctcaaagaaattcgaagaggaagtactcagtgtggcattttataagcgtgctctgaaggatttcagccatcttgtcgggaactgctcatttttcacggacgagaaacgcgccccgaagaatagccccctggcgtttatgttcgtggccttgaccagaataattaacctcctgaataacctgaaaaacacagaaggaatcttatacactaaggatgacctcaatgcacttctgaacgaggttttgaaaaatggcaccctaacatataagcagaccaagaaactgctcggcctgtctgacgattacgagtttaagggggaaaaaggaacttatttcattgagtttaagaaatacaaggagttcatcaaggctcttggtgaccacagcctgagtcaggatgacttgaacgagatcgccaaagatattacactcataaaggacgaaatcaaactgaagaaagcattagccaagtatgatctgaatcaaaaccagattgactctctatccaaactcgagtttaaggatcatctgaatatcagcttcaaggcacttaaattgataacccctctgatgctcgagggcaagaaatacgacgaagcctgtaacgagctgaatcttaaggtggctattaacgaagataaaaaggactttctgccagcgttcaatgagacgtactataaggacgaggtcactaaccccgtggtattgagggcaatcaaagaataccggaagatcctcaatgccctgctgaaaaagtatgggaaagttcacaagattaacatcgagttagctcgagaagtgggaaagaatcactcgcagcgcgccaaaattgagaaggaacagaacgagaactacaaagcaaagaaagatgccgagatagaatgcgagaagctaggcctcaagatcaattctaaaaacattctgaaacttagattgttcaaagaacaaaaggagttttgtgcttattccggtgaaaagatcaagctgtcagacctccaggatgagaaaatgctggagatcgaccatatttacccttatagtaggagcttcgatgactcctacatgaataaggtcttagtgtttaccaagcagaaccaagaaaaactgaataagacaccattcgaggcctttgggaacgattctactaaatggcagaagatagaagtgcttgctaaaaatttgcccgagaagaagcagaaacggatcctcgacaagaactacaaagataaggaacagaaagacttcaaggatcgcaatctgaacgacaccagatatattgcgaggctagtcctgaattacacaaaggattatctcgactttctgcctcttagcgacgatgagaacaccaaattgaatgacacgcaaaagggatcaaaagttcacgtggaggctaagagtggcatgctgacttccgccttacgtcatacatggggcttcagcgcaaaagatcggaacaatcacctccaccatgccatcgacgctgccattatcgcatacgctaacaactctatagtaaaggccttttcagatttcaagaaagaacaggagagtaatagcgtggaactgtatgcgaagaaaatctccgagcttgactacaagaacaaacgaaagtttttcgagccattttctgggttcagacagaaggtcctggataaaattgacgaaatcttcgtgtcgaagccggagaggaaaaagcccagcggagccttgcacgaagagacctttcgcaaagaagaggagttctatcagtcctacggtggcaaggaaggggttctcaaagctctggagctaggaaagattcggaaggtgaatggcaaaatcgtcaagaacggtgatatgtttagagtggacatattcaaacataagaaaactaataagttttacgcagtacctatttatacaatggatttcgccctgaaggttctcccaaacaaagctgtggccaggtcaaagaaaggggaaatcaaggactggattctgatggatgagaattacgaattttgcttcagtctttataaagactctttgatcctgatacaaaccaaggacatgcaggagcccgagttagtctactttaacgcattcacgagctccaccgtgtcactcatcgtcagcaagcacgataataaatttgaaacactgtctaagaaccagaaaattcttttcaagaatgcgaacgagaaagaagtgatcgccaagtccattggcatccagaatctgaaggttttcgagaaatatatagtgagtgctctaggagaagtaactaaggccgagtttcgccaacgagaggacttcaaaaagtga

SEQ ID NO: 2561 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagtcgagaatcccaagacaggtgaatcacttgccctgcctcggcgcttggcgcgaagtgctcgtaaaagattagccaggcggaaggcacgcctgaaccacctaaaacatctcatcgccaatgagtttaagctgaactacgaagattatcagagcttcgacgagtcccttgctaaggcatacaaaggctctctgatttcgccatatgagttgagatttagggccctcaatgaactgctgtcaaagcaagatttcgctcgggttatcctccacatagccaaacgccgagggtacgacgatatcaagaacagcgacgataaagagaagggagcgattttaaaggcaatcaaacagaatgaagagaagctggccaactatcagagtgtgggcgagtacctttataaagaatactttcagaagttcaaagaaaattccaaggaatttactaacgtaagaaataaaaaggagtcttacgaaaggtgtattgctcagagcttcttgaaggacgagctgaaactaatctttaagaaacaacgggagttcggtttttccttctcaaagaaattcgaagaggaagtgctcagtgtcgccttttataagcgtgcactgaaggatttcagccatcttgtggggaactgctctttctttacggacgagaaacgcgctccgaagaatagtcccctggcctttatgttcgttgcgttgaccagaataattaacctcctgaataacctgaaaaacacagaaggaatcttatacactaaggatgacctcaatgcccttctgaacgaggtgttgaaaaatggcaccctaacatataagcagaccaagaaactgctcggcctgtcagacgattacgagtttaagggggaaaaaggaacttatttcattgagtttaagaaatacaaggagttcatcaaggcacttggtgagcacaacctgagccaggacgatttgaatgaaatcgctaaagacattacactcataaaggatgagatcaaactgaagaaagccttagctaagtatgacctgaaccaaaatcagattgatagtctatctaaactcgagtttaaggaccatctgaacatctccttcaaggcccttaaattgataacccctctgatgctcgaaggcaagaaatacgatgaggcatgtaatgaactgaaccttaaggtcgccattaatgaggacaaaaaggattttctgccagctttcaacgagacgtactataaggacgaagtgactaatcccgtagttttgagggcgatcaaagagtaccggaaggtgctcaacgcactgctgaaaaagtatgggaaagtccacaagatcaatattgaattagcccgagaggtgggaaagaaccacagccagcgcgctaaaatcgaaaaggagcagaacgagaattacaaagccaagaaagacgcagaactagagtgcgaaaagctcggcctgaagattaactcgaaaaatatacttaagttgagactgttcaaagagcaaaaggaattttgtgcctattctggtgagaaaatcaagatttccgatctccaggacgagaaaatgctggaaatcgatcatatctacccttattcaaggagtttcgacgatagctacatgaacaaggtgttagtctttaccaagcagaatcaagagaaactgaacaagacaccattcgaagcatttgggaatgactccgccaaatggcagaagattgaggttcttgctaaaaacttgcccactaagaagcagaaacggatactcgataagaattacaaagacaaggaacagaaagatttcaaggaccgcaacctgaatgataccagatatatcgcgaggctagtgctgaactacacaaaggactatctcgattttctgcctctttctgacgacgagaataccaaattgaacgatacgcaaaagggaagcaaagtacacgtggaggctaagtcaggcatgctgacttccgccttacgtcatacatggggcttctccaccaaagaccggaataaccacctccaccatgcaattgatgccgtcatcattgcttacgccaacaatagcatcgtgaaggcattttctgacttcaagaaagaacaggagtcaaacagtgctgaactgtatgccaagaaaataagcgagcttgattacaagaataaacgaaagtttttcgagccattttccgggttcagacagaaggttctggacaaaatcgatgaaattttcgtgtctaagccggagaggaaaaagccctcgggagcgttgcacgaagagacttttcgcaaagaagaggagttctatcagagctacggtggcaaggaaggggtcctcaaagccctggagctaggaaagatccggaaggtgaacggcaaaattgtaaagaatggtgacatgtttagagttgatatcttcaaacataagaaaacaaacaagttttacgctgtgcctatatataccatggacttcgcactgaaggtcctcccaaataaagccgtggctaggtccaagaaaggggaaattaaggattggatcctgatggacgagaactacgaattttgcttctcactttataaagatagtttgattctgatccaaacgaaggacatgcaggagcccgagtttgtctactataatgccttcacctctagcacagtgtccttaatagtttcaaagcacgacaacaaatttgaaactctcagcaagaatcagaaaatcctgttcaagaacgcaaatgagaaagaagtgattgcgaagtctatcggcattcagaaccttaaggtattcgagaaatacatcgtctccgccctgggagaagtgaccaaggctgagtttcgccaacgagaggatttcaaaaagtga

SEQ ID NO: 2562 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccaaagtttcttgaaggacgagctgaaactaatctttaagaaacagcgggagttcggtttttccttctcaaagaaattcgaagaggaagtactcagtgtggcattttataagcgtgctctgaaggatttcagccatcttgtcgggaactgctcctttttcacggacgagaaacgcgccccgaaaaattctcccctggcgtttatgttcgtggccttgaccagaataattaacctcctgaataacctgaaaaacacagaaggaatcttatacactaaggatgacctcaatgcacttctgaacgaggttttgaaaaatggcaccctaacatataagcagaccaagaaactgctcggcctgtcagacgattacgagtttaagggggaaaaaggaacttatttcattgagtttaagaaatacaaggagttcatcaaggctcttggtgaccacagcctgagtcaggatgacttgaacgagatcgccaaagatattacactcataaaggacgaaatcaaactgaagaaggctttagccaagtatgatctgaatcaaaaccagattgactctctatccaaactcgagtttaaggatcatctgaatatcagcttcaaggcacttaaattgataacccctctgatgctcgagggcaagaaatacgacgaagcctgtaacgagctgaatcttaaggtggctattaacgaagataaaaaggactttctgccagcgttcaatgagacgtactataaggacgaggtcactaaccccgtggtattgagggcaatcaaagaataccggaaggttctcaatgccctgctgaaaaagtatgggaaagtgcacaagatcaacattgagttagctcgagaagtcggaaagaattactcgcagcgcgccaaaatcgagaaggaacagaacgagaactataaagcaaagaaagatgccgagctagaatgcgagaagctcggcctgaagattaattctaaaaacatacttaagttgagactgttcaaagaacaaaaggagttttgtgcttactccggtgaaaagatcaaaatttcagacctccaggatgagaaaatgctggagatcgaccacatctatccttacagtaggagcttcgatgacttttacatgaataaggtgttagtgttcaccaagcagaaccaagaaaaactgaatcagacaccatttgaggccttcgggaacgattccgcaaagtggcagaaaattgaagtccttgcgaagaatttgcccactaaaaagcagaagcggatactcgacaaaaactataaggataaagagcaaaaggactttaaagatcgcaatctgaacgacaccagatacatcgctaggctagttctgaattatacaaaggattacctcgacttcctgcctctttctgacgatgaaaacaccaagttgaatgacacgcagaaaggaagcaaggtgcatgtagaggccaaatcaggcatgctgactagcgcattacgtcacacatggggcttttccgccaaggatcggaacaatcatctccaccacgctattgacgccgtgatcattgcatatgctaacaacagcatcgtcaaagccttctctgattttaagaaggagcaggaatcaaatagtgcggagctgtacgccaaaaagataagcgaacttgactataaaaacaagcgaaaattctttgagccattctccgggttcagacagaaggtgctggataagatcgacgagatttttgtttctaaaccggaaaggaagaaaccctcgggagctttgcatgaggaaaccttccgcaaggaggaagagttttaccaaagctacggtggcaaagagggggtgctcaaggcactggaactaggaaaaatccggaaggtcaatggcaagattgtgaaaaacggtgatatgttcagagtagacatctttaagcacaaaaagactaataaattctatgccgttcctatatacacaatggattttgctctgaaggtgctcccaaacaaggccgtcgcaaggtccaaaaagggggagattaaagactggatcctgatggatgaaaattatgagttctgcttttcactttacaaggacagtttgattctgatccagaccaaagacatgcaggaacccgagttcgtgtattacaacgcgtttacgtctagcaccgtctccttaatagtgtcaaagcatgataataagttcgagacactcagcaaaaaccagaagatcctgttcaaaaatgccaacgaaaaggaggttattgctaaatctatcggcattcaaaatcttaaggtgtttgaaaagtatatcgtatccgccctgggagaggtcactaaagcagagttccgccagcgagaagactttaagaaatga

SEQ ID NO: 2563 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccaaagtttcttgaaggacgagctgaaactaatctttaagaaacagcgggagttcggtttttccttctcaaagaaattcgaagaggaagtactcagtgtggcattttataagcgtgctctgaaggatttcagccatcttgtcgggaactgctcctttttcacggacgagaaacgcgccccgaaaaattctcccctggcgtttatgttcgtggccttgaccagaataattaacctcctgaataacctgaaaaacacagaaggaatcttatacactaaggatgacctcaatgcacttctgaacgagtttttgaaaaatggcaccctaacatataagcagaccaagaaactgctcggcctgtcagacgattacgagttcaagggggaaaaaggaacttattttattgagttcaagaaatacaaggaatttatcaaggctcttggtgagcacaacctgagccaggacgatttgaatgaaatcgccaaagacattacactcataaaggatgagatcaaactgaagaaggctttagccaagtatgacctgaaccaaaatcagattgatagtctatctaaactcgagttcaaggaccatctgaacatctcctttaaggcacttaaattgataacccctctgatgctcgaaggcaagaaatacgatgaggcctgtaatgaactgaaccttaagattgctatcaatgaggacaaaaaggatttcctgccagcgttcaacgagacgtactataaggacgaagttactaatcccgtggtcttgagggcaatcaaagagtaccggaaggtgctcaacgccctgctgaaaaagtatgggaaagtacacaagattaatatcgaattagctcgagaggttggaaagaaccacagccagcgcgccaaaattgaaaaggagcagaacgagaattacaaagcaaagaaagacgccgaactagagtgcgaaaagctcggcctgaagataaactcgaaaaatatccttaagttgagactgtttaaagagcaaaaggagttctgtgcttattctggtgagaaaattaagatctccgatctccaggacgagaaaatgctggaaatcgatcatatttacccttattcaaggagttttgacgatagctacatgaacaaggtgttagtcttcaccaagcagaatcaagagaaactgaaccagacaccatttgaagccttcgggaatgactccgcaaagtggcagaaaatagaggtgcttgcgaagaacttgcccactaaaaagcagaagcggatcctcgataaaaattacaaggacaaagaacaaaagaactttaaagatcgcaatctgaacgacaccagatatattgctaggctagtgctgaattacacaaaggattatctcgacttcctgcctctttctgatgacgagaacaccaagttgaatgacacgcagaaaggaagcaaggtccacgttgaggccaaatcaggcatgctgactagcgcattacgtcatacatggggcttttccgccaaggatcggaacaaccacctccaccatgctatcgacgccgtgattatcgcatacgctaataacagcatagtaaaagccttctctgattttaagaaggaacaggagtcaaatagtgcggaactgtatgccaaaaagatcagcgagcttgactacaaaaacaagcgaaaattctttgagccattctccgggttcagacagaaggtgctggataagattgacgaaatctttgtctctaaaccggagaggaagaaaccctcgggagctttgcacgaagagaccttccgcaaggaagaggagttttatcaaagctacggtggcaaagaaggggtgctcaaggcactggagctaggaaaaattcggaaggttaatggcaagatcgtgaaaaacggtgatatgttcagagtcgacatatttaagcataaaaagactaataaattctacgccgtgcctatttatacaatggattttgctctgaaggtactcccaaacaaggccgttgcaaggtccaaaaagggggaaatcaaagactggattctgatggatgagaattacgagttctgcttttcactttataaggacagtttgatcctgatacagaccaaagatatgcaggaacccgagttcgtgtactataacgcgtttacgtctagcaccgtctccttaatcgtgtcaaagcacgacaataagttcgaaacactcagcaaaaaccagaagattctgttcaaaaatgccaacgagaaggaagtcatcgctaaatctattggcatccaaaatcttaaggtgtttgagaagtacatagtttccgccctgggagaagtgactaaagcagagttccgccagcgagaggactttaagaaatga

SEQ ID NO: 2564 - RNA, 2955 nt, synthetic construct
  misc_feature 1..2955: note = Cas9 variant
  source 1..2955: mol_type = other RNA
atggtgagaatcctggccttcgacattggcataagctccatcgggtgggctttttctgagaacgatgaactcaaggactgcggagtcaggattttcaccaaagttgagaatcccaagacaggtgaatcacttgcactgcctcggcgcttggcccgaagtgcgcgtaaaagattagctaggcggaaggcccgcctgaaccacctaaaacatctcatcgcaaatgagtttaagctgaactacgaagattatcagagcttcgacgagtcccttgccaaggcttacaaaggctctctgatttcgccatatgagttgagatttagggcactcaatgaactgctgtcaaagcaagatttcgcccgggtgatcctccacatagctaaacgccgagggtacgacgatatcaagaacagcgacgataaagagaagggagccattttaaaggcgatcaaacagaatgaagagaagctggcaaactatcagagtgtaggcgagtacctttataaagaatactttcagaagttcaaagaaaattccaaggaatttactaacgtgagaaataaaaaggagtcttacgaaaggtgtattgcccaaagtttcttgaaggacgagctgaaactaatctttaagaaacagcgggagttcggtttttccttctcaaagaaattcgaagaggaagtcctcagtgtggctttttataagcgtgccctgaaggatttcagccatcttgttgggaactgctcctttttcacggacgagaaacgcgcaccgaaaaattctcccctggcttttatgttcgtggccttgaccagaataattaacctcctgaataacctgaaaaacacagaaggaatcttatacactaaggatgacctcaatgcgcttctgaacgaggtcttgaaaaatggcaccctaacatataagcagaccaagaaactgctcggcctgtcagacgattacgagtttaagggggaaaaaggaacttatttcattgagtttaagaaatacaaggagttcatcaaggcccttggtgagcacaacctgagccaggacgatttgaatgaaatcgcaaaagacattacactcataaaggatgagatcaaactgaagaaggctttagccaagtatgacctgaaccaaaatcagattgatagtctatctaaactcgagtttaaggaccatctgaacatctccttcaaggctcttaaattgataacccctctgatgctcgaaggcaagaaatacgatgaggcctgtaatgaactgaaccttaaggtggcaattaatgaggacaaaaaggattttctgccagccttcaacgagacgtactataaggacgaagtaactaatcccgttgtgttgagggctatcaaagagtaccggaaggtcctcaacgcgctgctgaaaaagtatgggaaagtgcacaagatcaatattgaattagcacgagaggtgggaaagaaccacagccagcgcgccaaaatcgaaaaggagcagaacgagaattacaaagctaagaaagacgccgaactagagtgcgaaaagctcggcctgaagattaactcgaaaaatatacttaagttgagactgttcaaagagcaaaaggaattttgtgcatattctggtgagaaaatcaagatttccgatctccaggacgagaaaatgctggaaatcgatcatatctacccttattcaaggagtttcgacgatagctacatgaacaaggtcttagtttttaccaagcagaatcaagagaaactgaacaagacaccattcgaagcctttgggaatgactccgctaaatggcagaagattgaggtgcttgccaaaaacttgcccactaagaagcagaaacggatactcgataagaattacaaagacaaggaacagaaagatttcaaggaccgcaacctgaatgataccagatatatcgcaaggctagtactgaactacacaaaggactatctcgattttctgcctctttctgacgacgagaataccaaattgaacgatacgcaaaagggaagcaaagtgcacgtcgaggcgaagtcaggcatgctgactagcgctttacgtcatacatggggcttctccaccaaagaccggaataaccacctccaccatgccattgatgcagtgatcattgcctacgctaacaatagcatcgttaaggccttttctgacttcaagaaagaacaggagtcaaacagtgcagaactgtatgctaagaaaataagcgagcttgattacaagaataaacgaaagtttttcgagccattttccgggttcagacagaaggtgctggacaaaatcgatgaaattttcgtctctaagccggagaggaaaaagccctcgggagccttgcacgaagagacttttcgcaaagaagaggagttctatcagagctacggtggcaaggaaggggtgctcaaagcgctggagctaggaaagatccggaaggtaaacggcaaaattgttaagaatggtgacatgtttagagtggatatcttcaaacataagaaaacaaacaagttttacgccgtccctatatataccatggacttcgctctgaaggtgctcccaaataaagcagtcgccaggtccaagaaaggggaaattaaggattggatcctgatggacgagaactacgaattttgcttctcactttataaagatagtttgattctgatccaaacgaaggacatgcaggagcccgagtttgtgtactataatgctttcacctctagcacagtttccttaatagtgtcaaagcacgacaacaaatttgaaactctcagcaagaatcagaaaatcctgttcaagaacgccaatgagaaagaagtaattgcaaagtctatcggcattcagaaccttaaggtcttcgagaaatacatcgtgtccgcgctgggagaagttaccaaggccgagtttcgccaacgagaggatttcaaaaagtga

SEQ ID NO: 2565 - RNA, 2955 nt, synthetic construct
  misc_feature 1..2955: note = Cas9 variant
  source 1..2955: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccagagcttcttgaaggacgagctgaaactaatctttaagaaacaacgggagttcggtttttccttctcaaagaaattcgaagaggaagtactcagtgtggcattttataagcgtgctctgaaggatttcagccatcttgtcgggaactgctcatttttcacggacgagaaacgcgccccgaaaaattcccccttagcgtttatgttcgtggccttgaccagaataattaacctcctgaataacctgaaaaacacagaaggaatcctgtacactaaggatgacctcaatgcacttctgaacgaggttttgaaaaatggcaccctaacatataagcagaccaagaaactgctcggcctgtcagacgattacgagtttaagggggaaaaaggaacttatttcattgagtttaagaaatacaaggagttcatcaaggctcttggtgaccacagcctgagtcaggatgacttgaacgagatcgccaaagatattacactcataaaggacgaaatcaaactgaagaaggctttagccaagtatgatctgaatcaaaaccagattgactctctatccaaactcgagtttaaggatcatctgaatatcagcttcaaggcacttaaattgataacccctctgatgctcgagggcaagaaatacgacgaagcctgtaacgagctgaatcttaaggtggctattaacgaagataaaaaggactttctgccagcgttcaatgagacgtactataaggacgaggtcactaaccccgtggtattgagggcaatcaaagaataccggaaggttctcaatgccctgctgaaaaagtatgggaaagtgcacaagatcaacattgagttagctcgagaagtcggaaagaattactcgcagcgcgccaaaatcgagaaggaacagaacgagaactataaagcaaagaaagatgccgagctagaatgcgagaagctcggcctgaagattaattctaaaaacatacttaagttgagactgttcaaagaacaaaaggagttttgtgcttactccggtgaaaagatcaaaatttcagacctccaggatgagaaaatgctggagatcgaccacatctatccttacagtaggagcttcgatgactcctacatgaataaggtgttagtgtttaccaagcagaaccaagaaaaactgaatcagacaccattcgaggcctttgggaacgattctgcaaagtggcagaaaattgaagtccttgcgaagaatttgcccactaaaaagcagaagcggatactcgacaaaaactataaggataaagagcaaaaggacttcaaagatcgcaatctgaacgacaccagatacatcgctaggctagttctgaattatacaaaggattacctcgactttctgcctcttagcgacgatgaaaacaccaagttgaatgacacgcagaaaggatcaaaggtgcatgtagaggccaaaagtggcatgctgacttccgcattacgtcacacatggggcttcagcgccaaggatcggaacaatcatctccaccacgctattgacgccgtgatcattgcatatgctaacaactctatcgtcaaagccttttcagatttcaagaaggagcaggaaagtaatagcgcggagctgtacgccaaaaagatatccgaacttgactataaaaacaagcgaaaatttttcgagccattttctgggttcagacagaaggtgctggataagatcgacgagattttcgtttcgaaaccggaaaggaagaaacccagcggagctttgcatgaggaaacctttcgcaaggaggaagagttctaccaatcctacggtggcaaagagggggtgctcaaggcactggaactaggaaaaatccggaaggtcaatggcaagattgtgaaaaacggtgatatgtttagagtagacatcttcaagcacaaaaagactaataaattttatgccgttcctatatacacaatggatttcgctctgaaggtgctcccaaacaaggccgtcgcaaggtctaaaaagggggagattaaagactggatcctgatggatgaaaattatgagttttgcttcagtctttacaaggactctttgattctgatccagaccaaagacatgcaggaacccgagtttgtgtattacaacgcgttcacgagctccaccgtctcattaatagtgagcaagcatgataataagtttgagacactctctaaaaaccagaagatcctgttcaaaaatgccaacgaaaaggaggttattgctaaatccatcggcattcaaaatcttaaggtgttcgaaaagtatatcgtaagtgccctgggagaggtcactaaagcagaatttcgccagcgagaggacttcaagaaatga

SEQ ID NO: 2566 - RNA, 2958 nt, synthetic construct
  misc_feature 1..2958: note = Cas9 variant
  source 1..2958: mol_type = other RNA
atggccaagatcctggctttcgacattggcataagctccatcgggtgggcatttgtggagaacgatgaactcaaagactgcggagtcagaattttcaccaaggccgagaatcccaaaacaggtgaatctcttgcgctgcctaggcggttggctcgctcagcccgaaagcgtttagcaagaaggaaagcccggctgaaccacctaaagcatctcatcgctaatgagtttaagctgaactacgaagattatcagagtttcgacgagagccttgcaaaagcctacaagggcactctgatttccccatatgagttgcgctttaaagctctcaatgaactgctgtctaagcaagatctcgccagagttatcttacacatagcgaaaaggcgggggtacgacaacatcaaaaattcggatgacaaggagaaaggagcaattctgaaggccgtgaaagaaaacgaggagaaacttgctaattataagtcagtaggcgaatacttgtataaggagtacttccagaaatttaaggaaaacagcaaggagttcatcaatgtgcgcaacaaaaaggaaagttacgagcgatgtattgcccagtcctttctgaaagatgagctaaagctcatcttccagaaacaaagagaatttggtttcaatttttctaagaagttcgaggaagaggtcctgagcgtggcattctataaaagggctcttaaggacttttcccatctggttgggaactgctcattctttgtggatgaaaaacgggccccgaagaatagtcccttggcgttcgagtttgtcgccctcacgcgtatagtgaacctgttaaacaatctgaacaaaaataacagctacattaaggacgatctcaatgcacttctgtctgaggtattgaagaacggaaccctaacatataaacagactaagaaaatcctgggcctctccgacgactacgaatttaagggccagaaagggaattatttcattgagttcaagaagtacaaagaatttatcaaggctctgtgtgagcacaaccttaatcaggatgacctgaacgaaatcgccaaagatattaccttggttaaggacgagacaaaactcaagaaagctctggccaagtatgatttaaatcaaaaccagatagagaatctgtcaaagatcgagttcaaagaccatctaaacattagctttaaggcactcaaactgatcgtgcctcttatgcgcgaaggaaagaaatacgatgaagtctgcaatgagttgaacctgaagaccgccataaacgaggacaagaaagagttcctcccagcttttaatgaaacttactataaggatgaagtgaacaatcccgtggtcctgagagcgattaaagagtacaggaaggttcttaacagtctgttgaaaaagtatggtaaggtgcacaaaatcaatatcgaactcgcacgggaggtaggcaagaaccaccgagagcgctctaaaattgaaaaggagcagaatgaaaacttcaaagccaagaaggacgctgagctggaatgtgagaaattagggctgaagatcaattccaaaaacattctaaagctcagactgttcaaagagcagaaggaattttgcgtgtacagcggagagaaaataaagatctcggatcttcaagacgaaaagatgttggagattgaccatatctatccttactctaggtccttcgatgactcatatatgaataaagtcctggtgtttacaaagcagaaccaggaaaaactcaataagaccccattcgaggcctttggcaaagatgacgttaagtggcaaaagatcgagacgctggcaaagaacttacccgccaagaaacagaagcggattctggataaaaattacaaggacaaggaacagaaagatttcaaggaccgcaaccttaacgatactagatacatagctaggttggtgctcaattataccaaagactacctggagtttctacctctgagtgatgacgaaaacatcaagctcaatgatacacagaaaggtagcaaggtccacgtggaggccaagtccgggatgctgacttctgtacttcgtcatacctggggattcagcacaaaagaccggaacaatcacttgcaccatgcaattgacgcggttatcattgcttatgccaacgcatcagtggtcaaggcctttagtgatttcaaaaaggagcaagaaaattacaccgctgagctgtatgccaaaaagatcaacgaattagactttaagaataaacgaaagttctttgagccattctccaacttcagacagaaagtgctcgaaaagatagatgagatctttgtcagcaaaccggagaggaagaaaccctctggcgcactgcacgaagagacgttctacaaggaagaggaattttataaggagtacggcgggaaagagggagtgcttaaggctctggaattgggtaaaattcgcaaggttaatggcaaaatcgtgtcaaacgccaatatgttccgggtagacatttttaagtacaagaaaactaacaagttctatgcggtccctatctacacaatggattttgccctcgggatactgccaaataaagctgtggttggaggcaaggacaaacagggtattatcaaggattggctactgatggacgagaactatgagttctgttttagtctctacaaggatagcctgattcttttgcagaccaaagacatgcaagaacccgaactggtgtatttcaagtcctttaaatcttcgactgcagggttagtcgtgagcaagcatgataacaaattcgagaatctcaacgagaatcagaagaagctgttcaaatccgccaacgaaaagaaagtagtggctgagggcatcggaatacagaatcttaaggtttttgaaaaatacatcgtctcagccctgggcgagattacaaaggcagagatcaaagaaagagagaacttcaagaagaaatga

SEQ ID NO: 2567 - RNA, 2961 nt, synthetic construct
  misc_feature 1..2961: note = Cas9 variant
  source 1..2961: mol_type = other RNA
atgcccagcgaccctgccgaggctaagccactggaactccttgatccgtacgcactgagagcccagggcttggaccaagcgttacccctgacccacttcgggagggctctatttcatctcaaccagcggcgcggattcaaatccaatcgaaagacagatcgtggtgacaacgagaatggcaaaatcaaggatgcctctcagagactggactgggcaatgcacgaagccaaagctaggacttatggggagtttcttcatctgcggcgccagaaggcacctgatccaagacaagtgcccacggtcaggacccggttgtcagttggaaagcgcggcggtcctgacgccaaagaagaggctgggtacgatttctatccagaccgaagacacctcgaggaagagtttcatgaactgtggagtgcccaggcgcagttccaccccgagctgacacaggatctcagggacttagtgtttgagaagattttctaccaacggcctctgaaagaaccaaaggtaggactttgcttgtttactagcgaggaacgtctggcaaaagcccacccgctaacccagcgcagagtgctctatgagacagtcaaccagctgaggataaccgctgatggccggtccgtgcgacccctttctcgcgaacagagagaccaaatcattctggccttggacactaagaagcctacaaaatcgctcaattcaatggttgtgaccctgcaggcattaggcaaggtcctgaaactcagggagggggagcggttcacgcttgaaagcggagtgcgcgaggctatcgcctgtgatccagtaagagcggccatgctggcaacttttggtcccaggtggagtgctttggactggcctgaacagtggcaagttatttcccgtgtgcggaagctacaggatgacaaagatttcgccgagctggtcgaatggctcatcgagctgtacggcgtggacaaggaggctgccgtgaaaatagcaaacacccatcttccagaagggtatggacgactgggcttgacagccactaccagaatcctcgataggctgaagtctaatgtctttacatacgctcaggcggttgcagcctgcggttggcaccatagcgaccagcgcaccggggagtgtttagatcggctgccctactatggagctgtgctagacagacacgtaattccgggcacgtacgatgaaaacgacgacgatatcactaggttcggccgcattacaaatcctaccgtgcacatcgggctcaaccaactgcgacggcttgtcaataagataattgaggtgtatggaaaacccaaccagatcgttgtggaattggcccgtgagctgaagcagtccgagcagcagaaaaatgacgcaattaagctcatcagagatactacaaccgccgctaaacagaggtcagaaaagctggaggaacttggtatcacggacaacggccgcaatcggatgctgttgagactctgggaggatctgaacccagacgatgccatgaggcgattctgcccttacaccgggcagcgcattagtgcagcgatgatatttgacggaagctgtgatgtcgaccatatcttaccctattctcggacactggatgacggcttcgctaacagaactctatgcctcagggaggccaatcgtgaaaagcgcaaccagaccccatgggaggcatggggtgggacacccaattgggaagccattgagactaacctgaaaaatcttcctgaaaacaagcggtggagatttgctccagatgccatggcaaggttcgagggcgagaatgactttttggaccgagctctggtggatacccaatacctcgcccggatctcccgcacatatctggacaccttattcactgaaggaggccacgtatgggttgtgccggggagactgacggagatgcttaggcggcattggggattgaactcactcctgacagataaagaccgaggtgcggtcaagagcaaaaatagaaccgatcaccgccatcacagtatagacgccgctgtggtcgcagccactgataggtctctactgaaccgtatttcccgggctgccggccagggggaagtggcaggacagagcgcggagctcatcgccagagaaacaccccctccatgggagggctttaggaatgacctgaagtcgcagcttggtcgcatcattgtttctcaccgagctgatcatgggagaatcgaccggcaagccaggaagcagggccgcgattccaccgcaggacagttgcaccaagagaccgcttactcaattgtggacgatactcgtgtagccagtagaatagacttcctgagcgtcaaacccgcacagttactcgaccagcctggccggtccgggcaagtgagggatctgcaacttcgcaaggccctgcgagttgctacaggagacttgacgggtaaagattacgaaaaggcgctcagagactttgccgcaaaaccaggcccctataaggggatccggagggtgcgcattatcaagccgctgcaggagcaggctagagtccctgtgccagtactagatcccatcaaagcctaccagggaggctctaaccatgtgttcgaaatttggcatctgcctgacggtaaggttgagccccaagtcataaccagctttgaagcccacgctctcgaggtggagaaaaggccacaccctgcagccaagcggctgcttcgtgtgcacaaaggggatatggtcgcgttgaagcgcgaaggccgaactgttgtgggacatgtgcagcagatgcacatcaaaaatggcctgttcattgtaccccataacgaggctaatgccgacgcaagaaactcagataggacagacccatttaagtggatccagattgccgctcaaccggcaatcgccgcggggatacggcgcgtcgctgtggatgaaatcggaagattaagggacggcggtgccaagaccatttga

SEQ ID NO: 2568 - RNA, 2964 nt, synthetic construct
  misc_feature 1..2964: note = Cas9 variant
  source 1..2964: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttgagtcgaagcgctcgtaaaagattagccaggcggaaggcacgcctgaaccacctaaaacatctcatcgccaatgagtttaagctgaactacgaagattatcagtccttcgacgagtctcttgctaaggcatacaaaggctcgctgatttcaccatatgagttgagatttagggccctcaatgagttcctgagcaagcaagattttgctcgggtcatcctgcacatagccaaacgccgagggtacgacgatatcaagaacaatggagacgaggaaaaaggcgagattctcaaggcgatcaagcagaacgaggaaaaattagttagttatcagtccgtgggtgagtacctgtataaggaatacttccagaaatttaaggaaaattctaaagagttcattaacgtaagaaataagaaagaaagctacgagaggtgtatcgcacaatcctttcttaaggatgaattgaagctgatattccagaaacagcgggagtttgggttctcattcagtaagaaatttgaagaggaagtgctaagcgtcgccttctataagcgtgctctcaaagacttttctcatctggtgggaaactgctccttctttactgatgagaagcgcgccccgaaaaattcaccccttgcattcatgtttgttgctctgacgagaattatcaacttgctcaataacctgaaaaacaccgagggcattttatacacaaaggacgatctgaatactctccttaacgaagtgctgaaaaatggcaccttgacatataagcagaccaaaaagctactggggctcagcaacgactacgagttcaagggagaaaaaggtacttattttatcgagttccaaaagtacaaagaatttgtcaaggccctgggcgagcacaatcttagtcaggacgatctgaacgagatcgcgaaagacattacattgataaaggatgaaatcaagctcaaaaaggccctggcaaaatatgacttaaatcagaaccagattgattctctgtccaagctagagttcaaagaccatctcaatatcagctttaaggctctgaaacttataacccctttgatgctggaagggaagaagtacgatgaggcctgtaacgagctcaatctgaaagtggctattaacgaagacaagaaagatttccttccagccttcaatgagacgtactataaggacgaagtaactaaccccgttgtgctgagggcaatcaaagagtaccggaaggtcttgaatgccctcctgaagaaatatggaaaggtgcacaaaatcaacattgaattagctcgagaggtgggcaagaaccactcgcaacgcgcgaaaatcgagaaggaacagaatgagaactacaaggcaaagaaggatgccgaactggagtgcgaaaaactaggtctcaagattaattctaaaaacatactgaaacttagattgtttaaggagcagaaagagttctgtgtctattccggggaaaagatcaaaatttcagacctgcaagacgagaagatgctcgaaatcgatcatatctacccttatagtaggagctttgacgattcctacatgaataaagttctggtgttcaccaagcagaaccaggagaaattaaataagacaccatttgaaactttcggaaacgaccgggtaaagtggcagaaaattgaggtgctggctaagaatcttcccaccaaaaagcaaaaacgcatattggataagaactacaaggacaaagagcagaaggattttaaagacagaaatctcaacgatacaaggtatatcgcccgtctggtcctaaattacaccaaggactatctggatttcctccctctgtctgacgatgaaaacacgaaacttaatgacactcagaagggcagcaaggtgcacgttgaggcaaaatcaggcatgttgacaagtaccctgcggcatacttgggggttttccacaaaggaccgagataaccacttacaccatgccattgacgctgccatcattgcatacgcgaacaatagcatcgtgaaggctttctctgattttaagaaagaacaggagtcaaacaccgccgagctctatgcaaagaagataagtgaactggactacaaaaataagagaaaattctttgagccattcagcggattcaggcaaaaacttctggataagatcgacgaaatttttgtctccaagccggagcgcaagaaaccctctggtgccttgcacgaagagacgttccggaaggaggaagagttttatcagtcgtacggcgggaaagaaggagtgctcaaggctctggagctaggcaaaatcagaaaggtaaacggtaaaatggttaagaatggggatatgttcagggtggacatttttaagcataaaaagaccaacaaattctacgccgtccctatctatacaatggattttgcactgaaggtgctcccaaataaagctgtcgtgcagggcaaggacaagaaaagcggactgataaaggattggattcttatggacgaaaactacgagttctgcttttccttgtataaagattcactgatcttaattcagactaaggacatgcaagagcccgaactcgtttactatgagcgcctggacagttctaatgccagccttaccgtgtccaaacacgataacaagttcgaaacactgtcaaagaatcagaaaatcctatttaagaacgcgaatgagaaagaagtaatagccaagagcatcggcattcagaacctcaaagtcttcgagaagtacatcgtgtctgctctgggggaggttactaaggcagagttccgacagcgggaagactttaaaaagtga

SEQ ID NO: 2569 - RNA, 2964 nt, synthetic construct
  misc_feature 1..2964: note = Cas9 variant
  source 1..2964: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccagagcttcttgaaggacgagctgaaactaatctttaagaaacaacgggagttcggtttttccttctcaaagaaattcgaagaggaagtactcagtgtggcattttataagcgtgctctgaaggatttcagccatcttgtcgggaactgctcatttttcacggacgagaaacgcgccccgaaaaattcccccttagcgtttatgttcgtggccttgaccagaataattaacctcctgaataacctgaaaaacacagaaggaatcctgtacactaaggatgacctcaatgcacttctgaacgaggttttgaaaaatggcaccctaacatataagcagaccaagaaactgctcggcctgtcagacgattacgagtttaagggggaaaaaggaacttatttcattgagtttaagaaatacaaggagttcatcaaggctcttggtgaccacagcctgagtcaggatgacttgaacgagatcgccaaagatattacactcataaaggacgaaatcaaactgaagaaggctttagccaagtatgatctgaatcaaaaccagattgactctctatccaaactcgagtttaaggatcatctgaatatcagcttcaaggcacttaaattgataacccctctgatgctcgagggcaagaaatacgacgaagcctgtaacgagctgaatcttaaggtggctattaacgaagataaaaaggactttctgccagcgttcaatgagacgtactataaggacgaggtcactaaccccgtggtattgagggcaatcaaagaataccggaaggttctcaatgccctgctgaaaaagtatgggaaagtgcacaagatcaacattgagttagctcgagaagtcggaaagaattactcgcagcgcgccaaaatcgagaaggaacagaacgagaactataaagcaaagaaagatgccgagctagaatgcgagaagctcggcctgaagattaattctaaaaacatacttaagttgagactgttcaaagaacaaaaggagttttgtgcttactccggtgaaaagatcaaaatttcagacctccaggatgagaaaatgctggagatcgaccacatctatccttacagtaggagcttcgatgactcctacatgaataaggtgttagtgtttaccaagcagaaccaagaaaaactgaatcagacaccattcgaggcctttgggaacgattctgcaaagtggcagaaaattgaagtccttgcgaagaatttgcccactaaaaagcagaagcggatactcgacaaaaactataaggataaagagcaaaaggacttcaaagatcgcaatctgaacgacaccagatacatcgctaggctagttctgaattatacaaaggattacctcgactttctgcctcttagcgacgatgaaaacaccaagttgaatgacacgcagaaaggatcaaaggtgcatgtagaggccaaaagtggcatgctgacttccgcattacgtcacacatggggcttcagcgccaaggatcggaacaatcatctccaccacgctattgacgccgtgatcattgcatatgctaacaactctatcgtcaaagccttttcagatttcaagaaggagcaggaaagtaatagcgcggagctgtacgccaaaaagatatccgaacttgactataaaaacaagcgaaaatttttcgagccattttctgggttcagacagaaggtgctggataagatcgacgagattttcgtttcgaaaccggaaaggaagaaacccagcggagctttgcatgaggaaacctttcgcaaggaggaagagttctaccaatcctacggtggcaaagagggggtgctcaaggcactggaactaggaaaaatccggaaggtcaatggcaagattgtgaaaaacggtgatatgtttagagtagacatcttcaagcacaaaaagactaataaattttatgccgttcctatatacacaatggatttcgctctgaaggtgctcccaaacaaggccgtcgcaaggtctaaaaagggggagattaaagactggatcctgatggatgaaaattatgagttttgcttcagtctttacaaggactctttgattctgatccagaccaaagacatgcaggaacccgagttagtgtattttaacgcgttcacgagctccaccgtctcactcatagtgagcaagcatgataataagtttgagacactgtctaaaaaccagaagatccttttcaaaaatgccaacgaaaaggaggttattgctaaatccatcggcattcaaaatctgaaggtgttcgaaaagtacatcgtaagtgccctaggagaggtcactaaagcagaatttcgccagcgagaggacttcaagaacgagctccggtga

SEQ ID NO: 2570 - RNA, 2964 nt, synthetic construct
  misc_feature 1..2964: note = Cas9 variant
  source 1..2964: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacaatggagacgaggaaaaatcagagattttaaaggcaatcaagcagaacgaggaaaaactggttaattatcagagtgtgggcgagtacctttataaggaatactttcagaaattcaaggagaactccaaagaatttattaatgtaagaaacaagaaagagtcttacgagaggtgtatcgcccaatctttcttgaaggatgaactgaagctaatatttcagaaacagcgggagttcggtttttccttctcaaagaaattcgaagaggaagtgctcagtgtcgctttttataagcgtgccctgaaagacttcagccatcttgtggggaattgcagctttttcactgatgagaagcgcgcaccgaagaactcccccttagtttttatgttcgtggctttgacgagaattatcaatctcctgaacaacctgaaaaataccgagggcattctgtacacaaaggacgatctcaacgcccttctgaatgaagtcttgaaaaacggaactctaacctataagcagacaaagaagctgctcggcctgtcagacgactacgagtttaagggggaaaaaggaacctatttcatcgagtttaagaaatacaaggagttcatcaaagcgcttgatgaacacagcctgagtcaagacgatttgaatgagattgccaaggacataactctcatcaaggatgaaattaaactgaagaaagcattagctaagtatgacctgaaagagaaccagatcgattctctatccaagctcgaatttaaagaccatctgaatattagcttcaaggcccttaagttgataacacctctgatgctcgagggtaaaaagtacgatgaggcttgtaacgaactgaatcttaaagtggccatcaacgaggacaagaaagattttctgccagcattcaatgaaacctactataaggacgaggtaacgaaccccgttgtgttgagggccatcaaggaataccggaaaattctcaatgctctgttaaagaaatatggcaaggtccacaaaatcaacattgagctggcgcgagaggtggggaagaatcactcgcagcgcgcaaagatagaaaaagagcagaacgaaaactacaaggccaaaaaggacgctgagctagaatgcgagaaactcggactgaagatcaattctaagaacattcttaaattgagactgttcaaggagcaaaaagaattttgtgtgtattccggcgagaagatcaaactctcagatctgcaggacgaaaagatgttagagatcgatcatatttacccttatagtaggagcttcgacgattcctacatgaataaagtcctggtttttgccaagcagaaccaagaaaaacttaataaaactccattcgaggcatttggtaacgactctaccaagtggcagaaaatagaggtgttgacaaagaatctccccactaaaaagcagaagcggatcctggataaaaactacaaggacaaagaacagaaggatttcaaagaccgcaatctaaacgataccagatatattgccaggctggtactcaattacacaaaggactatctggattttcttcctttgagcgacgacgagaacaccaagctgaatgatacgcaaaaagggtcaaaggtgcacgtcgaagctaaaagtggaatgttaacttccgccctccgtcatacatggggcttcagcaccaaggaccggaacaatcatctgcaccacgcaatcgatgcggtgattatcgcttacgccaacaactctatagttaaagcattttcagacttcaagaaggagcaggagagtaatagcgccgaactttatgctaaaaagatctccgagctggattacaaaaacaagcgaaaatttttcgaaccattttctggcttcagacagaaggtgttggacaagattgatgagatcttcgtctcgaaaccggaaaggaagaaacccagcggggccctccacgaggagacttttcgcaaggaagaggagttctatcagtcctacggaggtaaagaaggcgtgctgaaggcactagaactggggaaaattcggaaggtaaatggaaagatcgttaaaaacggcgacatgtttagagtggatatattcaagcataaaaagacaaataaattttacgctgtccctatttataccatggacttcgccctcaaggtgctgccaaacaaggcggtcgccaggagcaaaaagggtgagatcaaagattggattcttatggacgagaattacgaattttgcttcagtttgtataaggattctctgatcttaatacaaacgaaagacatgcaggagcccgaactcgtgtactttaacgctttcaccagctccacagtttcactgatcgtgagcaagcacgacaataagtttgagactctttctaaaaaccagaagattctgttcaaaaatgcaaacgaaaaggaggtaatcgccaaatccattgggatccagaatctaaaggtcttcgagaagtatatagtgagtgctctcggcgaagttaccaaagccgagtttcgccaacgagaagatttcaagaacgagctgcggtga

SEQ ID NO: 2571 - RNA, 2964 nt, synthetic construct
  misc_feature 1..2964: note = Cas9 variant
  source 1..2964: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccaatccttcttgaaggacgagctgaaactaatctttaagaaacagcgggagttcggtttttccttctcaaagaaattcgaagaggaagtactcagtgtggcattttataagcgtgctctgaaggatttcagccatcttgtcgggaactgctcatttttcacggacgagaaacgcgccccgaagaatagccccctggcgtttatgttcgtggccttgaccagaataattaacctcctgaataacctgaaaaacacagaaggaatcttatacactaaggatgacctcaatacccttctgaacgaggttttgaaaaatggcacactaacctataagcagactaagaaactgctcggcctgtctgacgattacgagtttaagggggaaaaaggaacatatttcattgagtttaagaaatacaaggagttcatcaaggcacttggtgagcacaacctgagccaggacgatttgaatgaaatcgctaaagacattaccctcataaaggatgagatcaaactgaagaaagccttagctaagtatgacctgaaccaaaatcagattgatagtctatctaaactcgagtttaaggaccatctgaacatctccttcaaggcccttaaattggtgacgcctctgatgctcgaaggcaagaaatacgatgaggcatgtaatgaactgaaccttaaggtcgccataaatgaggacaaaaaggattttctgccagctttcaacgagacttactataaggacgaagtgaccaatcccgtagttttgagggcgattaaagagtaccggaaggtgctcaacgcactgctgaaaaagtatgggaaagtccacaagatcaatatcgaattagcccgagaggtgggaaagaaccacagccagcgcgctaaaattgaaaaggagcagaacgagaattacaaagccaagaaagacgcagaactagagtgcgaaaagctcggcctgaagatcaactcgaaaaatattcttaagttgagactgttcaaagagcaaaaggaattttgtgcctattctggtgagaaaataaagatctccgatctccaggacgagaaaatgctggaaattgatcatatctacccttattcaaggagtttcgacgatagctacatgaacaaggtgttagtctttacaaagcagaatcaagagaaactgaaccagactccattcgaggcttttgggaatgactccgccaagtggcagaaaatcgaagttcttgcaaagaacttgcccaccaaaaagcagaagcggattctcgataaaaattacaaggacaaagaacaaaagaacttcaaagatcgcaatctgaacgacacaagatatatagcgaggctagtgctgaattacaccaaggattatctcgactttctgcctctttctgatgacgagaacacgaagttgaatgacactcagaaaggaagcaaggtacacgtggaggctaaatcaggcatgctgacaagtgccttacgtcatacctggggcttctccgcaaaggatcggaacaaccacctccaccatgccatcgacgctgtcattatcgcctacgcaaataacagcattgtgaaggctttttctgatttcaaaaaggaacaggagtcaaatagtgccgaactgtatgcgaaaaagatcagcgagcttgactacaaaaacaagcgaaaatttttcgagccattttccgggttcagacagaaggttctggataagatagacgaaatcttcgtgtctaaaccggagaggaagaaaccctcgggagccttgcacgaagagacttttcgcaaggaagaggagttctatcaaagctacggtggcaaagaaggggtcctcaaggctctggagctaggaaaaattcggaaggtgaatggcaagatcgttaaaaacggtgatatgtttagagtagacattttcaagcataaaaagacaaataaattttacgcagtgcctatctataccatggatttcgccctgaaggtcctcccaaacaaggctgtggccaggtccaaaaagggggaaataaaagactggattctgatggatgagaattacgaattttgcttctcactttataaggacagtttgatcctgattcagacgaaagatatgcaggagcccgagttagtctactttaacgcattcacctctagcacagtgtccctcatcgtttcaaagcacgacaataagtttgaaactctgagcaaaaaccagaagatacttttcaaaaatgcgaacgagaaggaagtgatcgccaaatctattggcatccaaaatctgaaggtattcgagaagtatattgtctccgctctaggagaagtgaccaaagccgagtttcgccagcgagaggacttcaagaacgaactccggtga

SEQ ID NO: 2572 - RNA, 2964 nt, synthetic construct
  misc_feature 1..2964: note = Cas9 variant
  source 1..2964: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccaatctttcttgaaggacgagctgaaactaatctttaagaaacagcgggagttcggtttttccttctcaaagaaattcgaagaggaagtactcagtgtggcattttataagcgtgctctgaaggatttcagccatcttgtcgggaactgcagctttttcacggacgagaaacgcgccccgaaaaattcccccttagcgtttatgttcgtggccttgaccagaataattaacctcctgaataacctgaaaaacacagaaggaatcctgtacactaaggatgacctcaatgcacttctgaacgaggttttgaaaaattcaaccctaacatataagcagaccaagaaactgctcggcctgagcgacgattacgagtttaagggcgaaaaagggacttatttcattgagtttaagaaatacaaggagttcatcaaggctcttggagaccacagtctgtctcaggatgacttgaacgagatcgccaaagatattacactcataaaggacgaaatcaaactgaagaaggctttagccaagtatgatctgaatcaaaaccagattgactccctaagcaaactcgagtttaaggatcatctgaatatctcgttcaaggcacttaaattgataacccctctgatgctcgagggtaagaaatacgacgaagcctgtaacgagctgaatcttaaggtggctattaacgaagataaaaaggactttctgccagcgttcaatgagacgtactataaggacgaggtcactaaccccgtggtattgagggcaatcaaagaataccggaaggttctcaatgccctgctgaaaaagtatggcaaagtgcacaagatcaacattgagttagctcgagaagtcgggaagaattactctcagcgcgccaaaatcgagaaggaacagaacgagaactataaagcaaagaaagatgccgagctagaatgcgagaagctcggactgaagattaattccaaaaacatacttaagttgagactgttcaaagaacaaaaggagttttgtgcttactcaggcgaaaagatcaaaattagtgacctccaggatgagaaaatgctggagatcgaccacatctatccttacagcaggtccttcgatgactcttacatgaataaggtgttagtgtttaccaagcagaaccaagaaaaactgaataagacaccattcgaggcctttggtaacgatagcgcaaaatggcagaagattgaagtccttgcgaaaaatttgcccactaagaagcagaaacggatactcgacaagaactataaagataaggagcagaaagacttcaaggatcgcaatctgaacgacaccagatacatcgctaggctagttctgaattatacaaaggattacctcgactttctgcctctttcagacgatgaaaacaccaaattgaatgacacgcaaaaggggagtaaagtgcatgtagaggccaagtccggaatgctgactagcgcattacgtcacacatggggcttctctgccaaagatcggaacaatcatctccaccacgctattgacgccgtgatcattgcatatgctaacaactcaatcgtcaaggcctttagtgatttcaagaaagagcaggaaagcaattccgcggagctgtacgccaagaaaatatctgaacttgactataagaacaaacgaaagtttttcgagccattttcgggcttcagacagaaggtgctggataaaatcgacgagattttcgttagcaagccggaaaggaaaaagccctccggggctttgcatgaggaaacctttcgcaaagaggaagagttctaccagtcatacggaggtaaggagggcgtgctcaaagcactggaactagggaagatccggaaggtcaatggaaaaattgtgaagaacggcgatatgtttagagtagacatcttcaaacacaagaaaactaataagttttatgccgttcctatatacacaatggatttcgctctgaaggtgctcccaaacaaagccgtcgcaaggagtaagaaaggtgagattaaggactggatcctgatggatgaaaattatgagttttgcttctctctttacaaagacagcttgattctgatccaaaccaaggacatgcaggaacccgagttagtgtattttaacgcgttcacgtcctcaaccgtcagcctcatagtgtctaagcatgataataaatttgagacactgtccaagaaccagaaaatccttttcaagaatgccaacgaaaaagaggttattgctaagagtatcgggattcagaatctgaaggtgttcgaaaaatacatcgtaagcgccctaggcgaggtcactaaggcagaatttcgccaacgagaggacttcaaaaacgagctccggtga

SEQ ID NO: 2573 - RNA, 2964 nt, synthetic construct
  misc_feature 1..2964: note = Cas9 variant
  source 1..2964: mol_type = other RNA
atggccagaatcctggctttcgacattggcataagctccatcgggtgggcattttctgagaacgatgaactcaaggactgcggagtgaggattttcaccaaagccgagaatcccaagacaggtgaatcacttgcgctgcctcggcgcttggctcgaagtgcccgtaaaagattagcaaggcggaaggcccgcctgaaccacctaaaacatctcatcgctaatgagtttaagctgaactacgaagattatcagagcttcgacgagtcccttgcaaaggcctacaaaggctctctgatttcgccatatgagttgagatttagggctctcaatgaactgctgtcaaagcaagatttcgcccgggtcatcctccacatagcgaaacgccgagggtacgacgatatcaagaacagcgacgataaagagaagggagcaattttaaaggccatcaaacagaatgaagagaagctggctaactatcagagtgttggcgagtacctttataaagaatactttcagaagttcaaagaaaattccaaggaatttactaacgtgagaaataaaaaggagtcttacgaaaggtgtattgcccagagcttcttgaaggacgagctgaaactaatctttaagaaacaacgggagttcggtttttccttctcaaagaaattcgaagaggaagtactcagtgtggcattttataagcgtgctctgaaggatttcagccatcttgtcgggaactgctcatttttcacggacgagaaacgcgccccgaaaaattcccccttagcgtttatgttcgtggccttgaccagaataattaacctcctgaataacctgaaaaacacagaaggaatcctgtacactaaggatgacctcaatgcacttctgaacgaggttttgaaaaatggcaccctaacatataagcagaccaagaaactgctcggcctgtcagacgattacgagtttaagggggaaaaaggaacttatttcattgagtttaagaaatacaaggagttcatcaaggctcttggtgaccacagcctgagtcaggatgacttgaacgagatcgccaaagatattacactcataaaggacgaaatcaaactgaagaaggctttagccaagtatgatctgaatcaaaaccagattgactctctatccaaactcgagtttaaggatcatctgaatatcagcttcaaggcacttaaattgataacccctctgatgctcgagggcaagaaatacgacgaagcctgtaacgagctgaatcttaaggtggctattaacgaagataaaaaggactttctgccagcgttcaatgagacgtactataaggacgaggtcactaaccccgtggtattgagggcaatcaaagaataccggaaggttctcaatgccctgctgaaaaagtatgggaaagtgcacaagatcaacattgagttagctcgagaagtcggaaagaattactcgcagcgcgccaaaatcgagaaggaacagaacgagaactataaagcaaagaaagatgccgagctagaatgcgagaagctcggcctgaagattaattctaaaaacatacttaagttgagactgttcaaagaacaaaaggagttttgtgcttactccggtgaaaagatcaaaatttcagacctccaggatgagaaaatgctggagatcgaccacatctatccttacagtaggagcttcgatgactcctacatgaataaggtgttagtgtttaccaagcagaaccaagaaaaactgaatcagacaccattcgaggcctttgggaacgattctgcaaagtggcagaaaattgaagtccttgcgaagaatttgcccactaaaaagcagaagcggatactcgacaaaaactataaggataaagagcaaaaggacttcaaagatcgcaatctgaacgacaccagatacatcgctaggctagttctgaattatacaaaggattacctcgactttctgcctcttagcgacgatgaaaacaccaagttgaatgacacgcagaaaggatcaaaggtgcatgtagaggccaaaagtggcatgctgacttccgcattacgtcacacatggggcttcagcgccaaggatcggaacaatcatctccaccacgctattgacgccgtgatcattgcatatgctaacaactctatcgtcaaagccttttcagatttcaagaaggagcaggaaagtaatagcgcggagctgtacgccaaaaagatatccgaacttgactataaaaacaagcgaaaatttttcgagccattttctgggttcagacagaaggtgctggataagatcgacgagattttcgtttcgaaaccggaaaggaagaaacccagcggagctttgcatgaggaaacctttcgcaaggaggaagagttctaccaatcctacggtggcaaagagggggtgctcaaggcactggaactaggaaaaatccggaaggtcaatggcaagattgtgaaaaacggtgatatgtttagagtagacatcttcaagcacaaaaagactaataaattttatgccgttcctatatacacaatggatttcgctctgaaggtgctcccaaacaaggccgtcgcaaggtctaaaaagggggagattaaagactggatcctgatggatgaaaattatgagttttgcttcagtctttacaaggactctttgattctgatccagaccaaagacatgcaggaacccgagtttgtgtattacaacgcgttcacgagctccaccgtctcattaatagtgagcaagcatgataataagtttgagacactctctaaaaaccagaagatcctgttcaaaaatgccaacgaaaaggaggttattgctaaatccatcggcattcaaaatcttaaggtgttcgaaaagtatatcgtaagtgccctgggagaggtcactaaagcagaatttcgccagcgagaggacttcaagaacgagctacggtga

SEQ ID NO: 2574 - RNA, 2979 nt, synthetic construct
  misc_feature 1..2979: note = Cas9 variant
  source 1..2979: mol_type = other RNA
atgagaatcttcagcgacggcaggaaccccaaggatgggtcctctctggccgtgacccggcgcgctgcacgagccatgcgtagaaggcgggaccgcctccttaaaagaaagacaaggatgcaggcgaaactggtcgagcacggatttttccctgctgatgccggtaagcggaaagcattggaacaattaaatccatacgccctgcgcgctaagggcctacaggaggcactcctgccgggggaatttgcccgagctcttttccatattaaccagagaaggggatttaagtcaaatcggaaaactgacaagaaagataacgacagtggcgttctgaagaaagccataggtcagttgcgtcaacagatggcggagcaggggagccgcacggtgggagaatatctctggaccagactgcagcaaggccagggcgtaagggcacggtaccgagagaagccctatacaactgaggaagggaagaaacgcatcgataagtcctacgacctgtatattgatagagccatgatcgagcaggagttcgacgctctctgggccgcacaggctgcctttaatcctaccttattccacgaagcggccagggcagatctgaaagacacacttttgcatcaacggccactgcgccccgtgaagcctggaagatgcaccctactcccagaggaagagagggctcccctggcccttccttctactcagcgttttcggattcaccaggaagtcaaccatctgcgattgctcgatgagaatctgagagaagtggctttaacactggcccaaagggacgcagttgtgaccgccctcgagacgaaagctaaactttcgttcgagcagatccgcaaactgttgaagctatcaggtagcgtccagtttaacctggaagacgcgaagcggactgagctcaaaggcaatgcaaccagtgccgctctggccagaaaggaacttttcggggcagcctggtccggatttgatgaggctctgcaggacgaaatagtgtggcaattggtaacagaggagggcgaaggtgccctcatcgcatggctgcagactcacaccggggttgatgaggcgagggctcaggccattgtggacgtctctttaccagaaggatacggcaacctgagccgcaaagcactagcccgaatcgtgccggctctccgggccgcagtgattacatatgataaggctgtccaggccgcgggcttcgaccaccattcccaactggggttcgagtacgatgcctcagaagttgaggaccttgtgcaccccgagaccggagaaatccgtagtgtatttaaacagttgccttactatggtaaggctctgcagagacatgtggcattcggcagcgggaagccagaggatcccgacgaaaagaggtacggaaagatagccaatcctacggtccacattggcctcaaccaggtgcgcatggttgtgaatgctctgatccggagatatggtaggccaactgaggtcgtgattgagcttgcccgagatctgaaacaatctcgcgaacagaaggtagaggcacagcggagacaggcggacaaccaaaggcgtaatgcccgcatccggagatccatcgctgaagttttggggattggcgaggaaagggtgcgaggatcagacatacagaaatggatctgttgggaggagctcagctttgatgccgcagaccggcgctgcccctacagtggcgtccagatttctgctgccatgctgttatccgatgaagtggaggtcgaacacatcctgccgttcagcaagacactagacgattcgctcaacaacagaaccgtggcaatgaggcaagccaatcggataaagcgaaacagaactccttgggacgctcgcgcggagtttgaagcccaggggtggtcttatgaggatattctgcagagggcagagcgtatgccccttcggaaaagatacaggttcgctccagacggatatgaacgctggttgggtgatgacaaggattttctggcccgagccctcaatgacacaagatacctgtcccgggttgctgcagagtacttaaggctggtgtgtcctggcacccgcgtaatccccgggcagcttacggccttgctccgtggaaaattcggcctgaacgatgtcctaggtctggacggggaaaagaatagaaacgaccatcggcaccatgcggtggatgcttgcgttatcggcgtgaccgaccaaggactcatgcagaggtttgccacagcatcagcccaggctcgcggcgatgggctgactcgacttgtcgacggaatgccaatgccctggcctacctatagagatcacgtggagcgggcagtaaggcatatttgggtgagtcaccgcccagaccacggtttcgaaggcgccatgatggaggagacaagctacgggatcagaaaagatggatccattaagcagaggcggaaggcggacggctctgctggtcgtgaaataagcaatttgatccgcattcatgaggccactcaaccgctgcgacacggggtttcagcagatggccagcccttagcctataaaggatacgtcggcgggagtaactattgtatcgaaatcaccgtgaatgacaagggaaaatgggagggcgaggtgatttccacatttagagcttacggtgtcgttagggccgggggaatgggccggctccgcaaccctcatgaaggtcagaatggcagaaagctgataatgaggcttgtgatcggggatagcgtgcggctggaggtagacggagcagaacgaaccatgagaattgtcaaaatctctggctcaaacgggcagattttcatggctccaatccacgaggccaatgtggatgcgcgcaacactgacaagcaagacgcctttacgtatacaagtaaatacgcaggcagcttgcagaaggctaagaccaggcgggttactatatcccccatcggagaagtgcgtgatcctggtttcaaagggtga

SEQ ID NO: 2575 - RNA, 2985 nt, synthetic construct
  misc_feature 1..2985: note = Cas9 variant
  source 1..2985: mol_type = other RNA
atgaccctgggcctcgaccttgggacaaacagcatcggatgggccctgattgatttcgacgataatcagcaacccagaaacttgatagcttgcggttccaggatctttcaggaggcagtggaagccaagactggcacgcctaaaaatcacgcgcggcgcaccgctcgagccgcacgtaagttagtcgccagaaggaaacagcggcgcacaaagctgctaaacctcctgattagacatgggcttctgccacaggacgttgctgagaggaatgcattgctcctggataaccaagccaataacccgtaccagctgcggaaacgcggactcgacgaaaagttagagcccttcgcttttggccgagccctgtatcaccttgcgcatagaaggggtttccagtctaatcggaaggcagcctcagatgaagacgggaaagtgaagactgctatcagtaccttgcgtgccgagatgcagggacgcacactgggcgcatttctagctgatcaacctacccagagaaggcggtacactgaccgagccatgtatgtagaggagttcgaacagctctggagcaaacaggcgtcctttacacaagaacagctgacccaggcccttaaggtggcaattcacaactctatcttctttcaacgcccactgaaatcgcagaagcatttggtcggcaagtgtacgttcgagcccactagaaaaagggctgccaaggctatactcctgacccagcggtttcgcatcttacaggatgtgaatcacctggccgttaaaaaccctattacaagagagttcaggccactcactcaagacgaacgtaataagttggcagaggccctggataaacagaagtcaatgacctggggagctgtgcggaaagtcatcgggtggaacaagaaggacagcttgcacgaaggtgagacatttaatctagaagagggcaaaaaggacaaactgattgggaaccgaaccgcgtgcgatctcagaggagcactgggcgacaggtgggatgcccttacggctcagcagcaagacgatctggtgactgacttgctcacaatcgataacaccgacggtttcctgaagcgcatgaaaactcattgggagttcgatgacgccacagcagaagtaatagccaagattgagttagaacccgggtacgctcggctgagtgccaaggcaatgagagcgatcctaccttatctcgagcagggaatgatttactccgatgcttgtaaagccgcaggctatgaccactctaatccaaaccagaggaccatcacggacaagctgggccttccgagcaatgttcgcaaccccgtggtccagaaagccttgtttgaaacccgaaaggtggtgaatgctatcgtccggaaatacgggaagcctgccgttattcgtgtggagatggcaagagatatgaagctgtccaaaaggcaaaaggaggaactccagaaagagcagaacaagcagaaaaaggctaatgaactggccgagggaatacttcgcaaggagttcggtatccaacagccagcgcgggccgacattcagaaatacaacctgtggttggaatgcaaggaggtatgtccctatacaggcactaccatctcaagagaaatgctctttagtcctgaggtggatgtcgaacatatactgccatacagcaggtctttagacgattcctatatgaataaaacactgtgcatggctactttcaaccgacaagtgaagctaaataacaccccctacgagattgggcagggagacccgctcgcatatgccgagatctttcagcgcatcaaaacactgcctttccccaagcggagaaggtttgaacagaaagagattgaaaccgataagttcatcgagcgtcaacttaatgacactcgctacatttgtgttgaagtgcgggattttcttcagcagctgggcgctccagtcgaggtgtcaaagggtgaggccacggcaaaactcagagggaggtggaagctgaacacattactgagccctgacggcagtaatgaaaaatatcgaggagatcaccggcaccatgcgatagacgccgtagttatcgctcttaccaaccgctctttgttccacaagctctccagactgagcgcccagtcgatttctctagataaatccaggtttgacgtgcccccaccctgggacggcttctacgatgacgtctacgagaagatcgataaggtgatcgtctcacatgctcctgcacggaaaattgggggagccctgcacgaagacactgcatatggtcattttaaggaggaagtggccgatccaaaaaccggcaaggttagtatagaggaccgattcgtgtacagaaaaccgctcgctacactgaccgcgaacgaggtagggaagatccgcgatgccaaggtcagggagttcgtggaagcacgtcttgctcaatttggaaataacagcaaaactgccttcggcgaccccaataaccctttgctgcacgccgatggtaagacaccaattcggacggttagattagtgaccaattttaacaaagctactacacacgcaatccagaaggggcagggcagggactataaattctttaagtacggaaataaccatcacgtcgaaattatcgagcatgtggaaaccggcaagcgcaaagggatattcgtaacagccatggaggcggctcgaagagtgcggggagttgccaatactgagaagtccgatatcgtccagaggaaccacggtgaagagtggcgctttgtgatgtctctcagcattaatgacctggtgtcaatccaagaagcagatcaggtccgtattatgagagttcagcttttcgacgccagtaacggcaatatcatatttcgggaccaaaaatccgctatgctggatgacaagttgagcaggtatcagaccaaagcacacctcctggtgtgccagaagattacgaccgatcccctagggaacctggccccttgtaatgactga

SEQ ID NO: 2576 - RNA, 2988 nt, synthetic construct
  misc_feature 1..2988: note = Cas9 variant
  source 1..2988: mol_type = other RNA
atgagcaaggtgctgggcctcgacatcggggccaactccattggatgggctcttatagatgacgaggaaaatgatatcattggtgcaggcgtcagagttttcaaagagggggtgaacctgaagggagtaaaagaagagtctaagaatgtggaaaggcgggccgcgcgcttggctcgacgtcagcacaaaagaaggtcacaacggcgcaacagattagtcgccctgctaaagaccctcgagatgtttcccgagaataacgaagacatcagtgattactatgcacaggacccttacgagctgaggaagaaaggcctttatgaaaagctgacaatgtacgagttcggtcgggtgttgctccatatttgccgccgaagagggtttaaaagctccaggaagactgatatctctgaggaaggaaaaatattcgagggcaaggacggcatcgttgggattaatcagacgcgggattcgatccgtgaaggaggttttaagaccattggcgagtatctggcctcactggacccacacgtgatccgcagaaggaaccggttcacactccgagatatgtacgaagaggagtttaatttaatgtgggaaaaacagcagagcttctatccgctgcaacttagtaacgagtttaaggaagctatagcagaggtcattttgtcccagcgcaaactgaagtctcagaaagccctagtggggaattgtggactcgaacccaacaagaaaactgctcctaagagctccccagccttccaatactttagaatcctggagcagctttcaaggattctgatcagtatcccccataccggccggtacaatgaccctttgaacgaggaggagcgcagaatgctcattgataagctgagcgtaacagaaaaattaaagttctctgacatgaggaaaatgctgaatctcccaggtgagtccgacataaacatcgaagaggaagggggacgtcttctgggcaacaccacttatgcgcggttgattaaggtttttggcaaaaagcgatgggcagggttctcagaagaggaaaaggagcagatctggcacacattccattttgccgataatcacgagtggctaaaagaatacgctctgaagaaatggagcataacccccgacgagattaaggaactcggaaaagtggccctggagaaggaatatgcaagattcagtaagaaatctcttaagaaaatcatccctcagctggaggagggtttgacgctcgataaggctaaaattgaagccggctacactccagagtatgaaatcgagaagtccctgagcgcgtacttaccgctgcccgaaaacattaggaatcctatagtccaacaggccctatatgagctccgccacgtggtgaacgcagtcatccggacctacgggaagccagacattgctagagttgagctggccagggaaatgaaaaagcccaaacagaagcgcgagaaaatgcgatcggaacttcggaagcgtcaaatgaaatttgaggaaatcaagtctatcttgaaggagagactgggattcattgatcctaaaagggacgagatacataagtacatgctctgggaagagtgccgcgaaacatgtccatatactggccggaaaatctccctgtcagctctttacggtggggattttgaggtggagcacattatcccctataagagaagtctggacgatagcttgttcaataaaaccgtatgcctcagggaagagaaccagattaagggcgaccgaacaccgtacgaagcctattccggagatcgccagaagtacgaggaaatcatactgcgggtgcagaaaacctctatgcctagaggcaagaaaaatttatttgcaatcaaggagctgaaagacgacttcgcccataggcaactaagcgatacggcttatatttcacgtgagactcgcaagtacctcgggagtacaatcaagaaagtccaggcggtgaagggaggttccaccgcaaaactgcggtactattggggccttaacagcattttgggggttagagacatcaagatgagggatgaccaccgacaccatgccgtggatgctctggtcatagccaatactacatacgcatttgtgaacaccctctctcggtatcactcaatggacgtagaaccccatgagagtcgcttcccactgccttgggaacagtttagaaatgatgccgagagcgttgtgaggaacattttcgtctcccaccggttaggcaaaaaggctacgggacagctgcatgaagagacctactatggtaagatccgaaatacagacggggagccctactttgtggtcagaaagaaacttggcactttgaccgccaaacaaattgcaaacatcgtggatccagttgtgaagacacaggtattcgaacgcctcgaggaaaaaggaatagacatcgagtcttcgaataagattcccgcggatgctttcgtcgaaactctgtatatgcctgacaggaaaaccccaatcaagagcgtgcgtgttaaggtgccgtccacaaccatgattcagctatacaaagataaggagctgtacgtcgaccccggctcaaaccaccacatcgtgatatttgagaacgaagaggggaaacgggacggaattgtagtgagtctcttcgaagccgcacagagactgaggcgcaatgagcctgttatccaaaagacttggaaaccagagtggcattttgtcatgtctcttagcatcgatgaattgattctgttagacgtggatgagaagaacatcgactggggtgatacgggcctcgccctgcgatattccaaggctctttacagagtgcagaaaatggacgtcaataagattataacactgcggcaccatttggttgccaggctcaaagatgacgaagggaaggagttcggacgcgaacaccgtatcccctcaaccctgagaggcctaaaagtgaagattgatcacatcggtcggctgaggcgcgcatatgactga

SEQ ID NO: 2577 - RNA, 2988 nt, synthetic construct
  misc_feature 1..2988: note = Cas9 variant
  source 1..2988: mol_type = other RNA
atgaaggtgatcggcttcgacattgggataaacagcatcggatgggcctttgtcgagaatgatgaactgaaagactgcggtgttagaattttcaccaaggctgagaaccccaaaaataaggaatccctcgcacttcctaggcggaacgccaggtcttcacgaaaacgtctgaagagaaggaagttgcggttaatcgcgatgaaacacattctggctaaggagctaaatctcaactacaaagattatatcgccaatgacggcgaactgccaaaggcatacgaggggaaacttataagtccgtatgagctgcgctacaaggccttgaaccagaagctcgaagctaaagatctggtgagagtaatcctgcatattgcaaagcacaggggatatatgaataaaaacgacaagaaaagcaatgatgccgagaagggcaaaatcctctccgctttaaagaacaatgccctgaaacttgaaaaataccaatctgtgggtgagtatttttacaaggagttctttcagaaatacaaggaaaacacaaaagacttcattaagatccggaatataaaggataactataacaattgtgtcttggcgtcggacctggagaaagaactaaagctcattctggagaaacagaaggaatttgggtactcatatagcaacgatttcatcgaggaggtgattcaggttgcatttttccaacgcccccttaaagactttagtcatctggtgggaacttgcacgttctttgaagaggaaaagcgagcctgtaaaaattcctactctgcttgggagttcgtcgccttgaccaaaatcgtgaacgaactcaagagcctggagaaaatctccggcgagttaatttcaacacagactataaatgaaatcctgaactatattctcgataagggcagtatcacctacaaaaagttcagaagctatataaatctttacgagtctattaagtttaaatccctgaagtacgacaaagacaacgcagaatcagctaagttgatcgatttcaggaagctagtagagtttaagaaagccctgggggaacactatttcaatcggcaggagctcgaccagatcagcacatacattaccctgatcaaggataacgttaaacttaaaactgcgctggagaagtataatttgagtaacgaacaaattaataacctcctggagatagaatttaatgaccatatcaacttatctttcaaagccctgtccatgattctacctctcatgaaggagggaaagaagtacgatgaggcatgcgaaatcgctaacctgaagccaaaaacaaccaatcagaagcaggactttcttcccgccttctgtaacagcatctttgtgcacgagttgtcgaatcctattgtcaaccgtgctatatctgaatatcgcaaagtgctgaatgccctcctgaagaaatacggtaaggtgcacaagatccatcttgagctggcaagagatattggcttgtccaaaaaggccagggaaaagatcgagaaggagcagaaagaaaaccaagctattaatacgtgggcgctcaacgagtgcgaaaatatggggatcaaggcaaacgccaagaatatactgaaattaaagctgtggaaagagcagaaggaaatctgtatttattcaggcaaaaagatcagtattgagcacctaaaagacgagaaggctctcgaagtcgatcatatctacccatacagccggtccttcgacgattcttatatgaacaaggttctggtgtttactaaagagaatcaggaaaaacttaacaaaacccccttcgaggcctttggaaagaatatagaaaaatggaacaagattcaaacattggcacagatcctgccttacaagaaaaagaacaaaattctcgacgagaatttcaaggacaaccagcagcaagatttcatcagccgaaatctgaacgacactcgctatatagccaccttaatcgctaaatacacaaaggagtatctgaattttcttccattgaacgaaaatgagaacattaatctcaagtcaggtgaaaaagggagtaagatccacattcagaccgtaaacggaatgctgacgtccgtgctaagacacacttggggcttcgataaaaaggacaggaataaccatctgcaccatgccctcgatgcaatcatagtcgcgtacagcacaaattctctgattaaggctttttcagacttcaagaagaaccaggagcttttgaaagccaagctgtatgcaaaagagttaaccaatgataactacatccaccaggccaagtttttcgaaccgtttgagggcttccgggagaaaatcctcaacaagattgacgaaatctttgtgagtaagccccctcgcaaaagagctcgcggggccctgcataaggaaactttctacagcgagaaaaagatgattaaaaagtataattccaaagagggacttaacatagcactggattgcggtaagatccgtaagattggcacaaaatacgttgaaaatgacaccatggtgcgggtcgatatctttaagaaacaaaacaagttctatgctattccaatctacacgatggactttgccttggggatactccccaataaaatcgtggtaattggaaaggataagaacaataaccctaaacagtggcaggagatcgacgaatcttatgagttctgtttctcgctgtacaagaatgacctaattctgctccagaaaaaggatatgcaagaagcggagtttgcctattacaacggcttcgacatcgatagctcccgaataaatattaaaaagcacgacaacaagtttgagaatctgacctcaaaccagaaacttttgttcacaaataaggagaaaaacagaactggtatccagaatctgaagatctttgaaaaatacattgttaccccattagggaacaagataaaggctgatttccagcccaggcaaaacatcagtctcaaatctagcaagaaaaatggcctgtga

SEQ ID NO: 2578 - RNA, 2988 nt, synthetic construct
  misc_feature 1..2988: note = Cas9 variant
  source 1..2988: mol_type = other RNA
atgaagatcctgggcttcgacattgggataaacagcatcggatgggcctttgtggagaatgatgaactcaaagactgcggtgtcagaattttcaccaaggctgagaaccccaaaaataaggaatcccttgcactgcctaggcggaacgcccgctctaatcgacgtagattgaaaaggcggaagtcacgcttaatcgcgattaagcacatcctggctaaagagctaaacctcaattacaaggattatatagccaacgacggcgaactgccaaaagcatacgaggggaagttaacaaatgtttatgagctgagatacaaagccttgaaccagaagctcgaagctaaggatctggcaagggtgatcctgcatattgccaaacaccggggatatatgaataagaacgagaaaaagagtaatgacagcgaaaaaggcaagatcctctccgctttaaagaacaatgccctgaaacttgagaagtaccaatctgtaggtgagtatttttacaaagagttctttcagaagtacaaagaaaacactaagaacttcattaaaatccgcaatacgaaggataactataataactgtgtgttggcgtcggacctggaaaaggagctaaaactcatactggaaaagcagaaagagtttgggtactcatataatgatgacttcattaaggagatcattaacatcgcatttttccagcgaccgcttaaagattttagccatctggtcggaagttgcaccttctttgaagaggaaaagagagcctgtaaaaattcctactctgcttgggagttcgtggccttgagcaagatcattaacgaactcaagaggctggagaaaatatccggcgagttaatctcagcacaaacaattaatgaaatcctgaaccacatactcgacaagggcaatattacttataaaaagttccggagttgcatcaaccttcatgagagcatcgaatttaagtctctgaattacgataaagacaacgctgagtccgccaagttggttgacttcaaaaagctaattgaatttaaaaaggcgctgggggagcactcattcaatcgtcaggagctcgatgaaatcgccacccacattacactgataaaagacaacgataaacttaagaccgcactggagaagtataacttgaataacgaacagatcaatgctctcctggagattgagtttaacgaccatatcaatcttagcttcaaggccctgaacctaatcctccccctgatgcgcgaaggaaaaagatacgatgaggcttgtgaaattgtgaatcttaagagtaaaacttctaaccagaagcaagacttgctgcctgccttttgcgattccatattcagccaggagctctcgaatccagtcgtgaacagggcaatctctgaataccggaaggtactgaatgcccttctgaaaaagtatggtaaagttcacaagattcatttggagctcgctcgagacgtgggcctgtccaaaaaggcgcgcgagaagatcgaaaaagagcagaaggaaaacaaagagattaatgattgggcattagacgaatgtgagaagtttgggctgaaagccaacaataagaacatcctaaagctcaaactgtggaaggagcagaaagaaatatgcgcttactcaggaaagaaaatcagtattgagcaccttaaggatgaaaaagccttggaggtcgaccacatctatccctacagcagatccttcgacgattcttatatgaacaaggtgctggtgtttacaaaggaaaatcaagagaaactcaacaagacccctttcgaggcatttggcaaaaatattgaaaggtggaacaagatccaggccctggctcagaatttaccatacaaaaagaagaacaaaatactggacgagaatttcaaggataaacaacagcaggacttcattagccggaaccttaatgatacgcgctatatcgccactttgattgcaaagtacaccaaagaatacctcaactttctgcccctaaatgagaacgagaatacaaacctgaagtcaggtgaaaaggggagtaaaatccatgtccagactataaatggaatgctcacctccgttctgagacacacatggggcttcgacaagaaagataggaacaaccatcttcaccatgcgttggacgctatcattgtggcctatagcaccaattctatcattaaggcattttcagatttcaaaaagaaccaagagctgttaaaggccaaactctacgctaaggaactgacgagtgacaattataaacaccaggccaagtttttcgagccttttgaaggcttccgtgagaaaatccttaacaagatagatgagatttttgtaagcaagccaccgcggaaacgagcaagagggactctgcacaaggaaacattctaccccgaggaaaccatgatcaaaaagtataattccaaagagggattgaacatcgctctcaattgtggtaagattaggaaaatcggcactaagtacgtggaaaacgacacaatggtccgcctggatatttttaagaaacagaataagttctatgccatacctatctacaccatggactttgcgctagggattctgccaaacaaaatcgtgattgccggaaaggacaaaaataacaatcccaagcagtggcaagagatcgatgagtcttacgagttctgcttctcgctctataagaacgacctgatacttttgcagaaaaaggatatgcaggaagctgaatttgcatactataatagcttcgacatcgattcctcacggattaacatcaaaaagcatgacaataaatttgagaacctgacggataaccagaagttactcttcaccaatcaagaaaagaacagaacaggcattcagaatctgaaaatctttgagaagtacatagttactcctcttggtgacaaaattaaggccgatttccagccaaggcagaacatcagtctgaaaacctctaagaagtatgggctatga

SEQ ID NO: 2579 - RNA, 2991 nt, synthetic construct
  misc_feature 1..2991: note = Cas9 variant
  source 1..2991: mol_type = other RNA
atgatgggcaacttcaccctggggctcgaccttggaacaaatagcatcggttgggccctgattgattttgacgataaccagcaaccccagaatttgatagcttgcggctccagaatcttccaggaggcagtggaagccaagactgggacgcctaaaaaccacgcgaggcgggctgcccgcgcagcccgaaagttagtcgctcgtagaaaacagaggcggaccaagctgctaaatctcctggtttgtcatgaccttctgccacaagatgaggcagaacgcaacgccttgctcctggacaatcaggctaacaatccgtaccagctgagaaaaaggggactcgatgagaagttagaaccctttgccttcggccgggcgctgtatcaccttgcacatcgccgaggttttcagtctaacagaaaggccgcttcagacgaggatgggaaagtgaagacagccattagtgcattgagggctgagatgcaaggacacactctgggcgccttcctagcggaccagcctacccagcggcgtcgctacacagatagagccatgtatgcagaagagtttgaacagctctggagcaaacaaaccatcttcgctccagagcagctgactcaggcccttaaggtagagattaaaaattccatctttttccaaaggcccctgaagtctcagaagcatttggtgggcaaatgcacatttgaacctacccggaagcgagctgccaaagcaatactcctggcccagcacttccgcatcttacaggacgtcaaccacctggctgtgaagaatccaattacgagagagtttaggcccctcactcaagatgaacggaacaaacttgcggaggcactggacaagcagaaagggatgaattggtcggccgttcgcaaggtgatcggatggaacaagaaagactcattgcatgaaggtgagaccttcaacctagaggaaggcaagaaagataagctgattgggaatagaacagcttgtgacctcaggggagccctgggcgatcgttgggacgcattcactgcccctcagcaggatgaccttgtcaccgatctgttgacaatcgacaacccagatggttttctcaaacggatgaagacccactgggggttcgacgatgctacggccgaggcactggcgactacagaattagagccgggatacgctcgactgagcagtaaggccatgagagcaatactaccccatctcgaacaaggcatgatttattccgacgcctgcaaagctgccggctacgaccactctaatcctaaccagaggaccatcactgataagctggggcttccaagcaatgtgcgcaaccccgtagttcagaaagcattgtttgagacacggaaggtggtcaatgctattgtgagaaaatatggaaagcctgccgtgatcagggtcgagatggcgcgcgacatgaagctgtccaaacgacagaaggaggaactccaaaaagaacagaacaagcagaaaaaggccaatgagctggctgaaggtatccttcggaaggagttcggcattcagcaaccagcacgtaccgatatacagaaatacaacctgtggttggagtgtaaggaagtttgcccctacacggggaccgtgatctcaagagagatgctctatagtccggaagtagacgtggagcacattctgccttacagcaggtctttagatgactcctatatgaataaaacactgtgtatggccacttacaaccgccagaccaagctaaataacacaccctatgagatcggacaaggcgatccagtcgcttacgccgaaatatttcagcggattaaaactctccctttccccaagagaaggcgatttgagcagaaagaaatcgagaccgacaagttcatcgaacgccagctgaatgatacacggtatatttgcgtggaggttagagactttcttcaacagttgggtgcaccagtggaggtctcaaagggggaagcgaccgccaaactgaggggccgttggaagctcaacactctgttaagccccggaggcgggaacgagaaaaatcgcgctgatcatcggcaccatgccatcgacgcagtggtaattgctctgacgaacagaagtcttttccacaagttgtctaggctctccgcccagagcatatcgtttgataaatctcgattcgacgttcctccaccgtgggacgatttttacgacgatgtgtacgaaaagatcgacaaggtcattgtgtcccatgcacccacacggaaaatctcaggagccctgcacgaggctaccgcgtatggtcacttcaaggaagagatcgccgatcctaaaactggcaagttcagtattgaggaccgctttgtctacagaaaaccactaaccacactgaccgcaaatgaagtggggaagataagggatgctaaggttcgggagctcgtggaagcccgactggcccagttcggaaacaatagcaaagctgcatttggcgaccccaacgagcctcttttgcatgccgatggtaagactccaatcagaacaattcgcctgacgaccaatttcaacaaaactacaacccacgcgatccaaaaggggcaggacagggattataaatttttcaagtacggcaataaccatcacgtagaaattatcgagcacgtcgagacaggaaagcgtaaaggcatatttgtgactgctatggaagccgcacggagagcccgcggggttgctaataccgagaagtccaacatcgtgcagaggaatcatggagacggttggaaattcgtcatgtctttagcagtgaacgatatggtacgaacggaagacacccaggccatttatagagtgcaaaagctcgacggcagcaataaccggtttacactgaggtcacacaacgcggctactcttgatgacaaacagaccggggttgataagacacccaatctgttcaaaggaactaagatcattgtcgacccgttgggcaacctcacccagtgtaatgattga

SEQ ID NO: 2580 - RNA, 2994 nt, synthetic construct
  misc_feature 1..2994: note = Cas9 variant
  source 1..2994: mol_type = other RNA
atgaaggtgctggtcgacgccggcctcatgcccagcgatcctgctgcagccaaagcgcttgagaccctggacccatacgaattgagagctacagggttagatgttatgctgccgctaactcacctcggaagggccgtgttccatctgaaccagcggcgcggttttaagtccaatcgaaaaacggaccgtggcgataacgagtctgggaagatcaaagacgcaaccaagagacttacatgggccatgcaagaagctggagcaaggacttatggcgagttcctgcacatgcggcgcgccagagcttcagatcccaggcaggtacctagtgtgcggacccgcttgagcgtcgcctcccgaggtgggccagactctaaggaagaggcgggatacgatttttatcccgagagagcacatctcgaagacgagttccacgccctgtggtcggctcaggccgcatttcatcctgatctgacatgcgaactcagggacgtggttttcgagaaaatattttaccagcggccattaaaggagcccaaagtgggcctgtgtcttttcaccgctgaggaacgtttgcctaaggcccacccactgactggccgcagagtcctatatgaaacagtgaatcaactcagggtaaccgcggatgggcggacgactcgaccgctgacccttgaggaacgcgacatgattgtttacgccctggacaacaaaaagcccgtgaagtcattgagcagtatgcacctcaaactggtcgcattaggaaagctggtgaaactcaaggatggtgagagatttacacttgagtccggcgtgagggacgctatcgcctgcgatcctattcgggctactatggggcatccagacggattcggccccgcctggtctcgcctggattggcaggcacagtgggccttgatcgaaaaactaagacaggtccaaagcgacgatgactttgcttccctggttgcgtggctcggtgcaacccacaatctgtcagaggatcatgccaagagggtggctaaccttcatctgcctgaagggtatggacgtttgggcctcacagccaccgaggcaattctgtgtaatttaaaagccgaagtatgcacgtacagtcaggctgtggagcggtggggcaagcaccacagcaaccagcgaactggggagtgtctggaagccctaccatactatggagaggtcctcgacagacacgtgatccccggtacatacaatgaagatgacgacgatgttaccaggtatggccgcataactaacccgacagtgcatatcgggctgaatcagcttcggagattggtcaacaggattatcgcaacctacggaaagcctgaccaaattgtggtagagctggcgcgcgaactcaaacagtctgaggctcagaagtccgaggccctgaaaaagatccgagatacgaccgcagacgccatacggcgtggcagacaacttgaagagattggtcagaaaaatacaggggctaacaggctgttgctccgcctgtgggaagatttaggccccgccgttggaccacggtgctgtccttatactggcaagcccatctcagtgaccatgctgttcgacggggcatgcgatgtcgaccacattctaccatacagcagaacactcgatgacagttttgctaataggactatctgtctgcgagaggccaaccgccagaagggagatcggaccccctgggaggcgtggggtggctctgaccagtgggatgccatcgaagctaaccttaaagacttgcctgagaataagagaaaaaggttcgcaccagacgccatggaacgtttcgagggggaacgcgattttctggaccgggctctcgtggatacacaatatctggccagaatttccagggcatacttagacaccctgttcactgagggaggccatgtctgggtggttccgggtcgaatgacggagatgcttcggcgccactgggggttgaacgcgctcctgagcgataaggacagaggcgccggaaaagtgaagaataggacagatcaccggcatcacgctatagacgccgcagtaatcgctgccaccgatcattcgctagtcaaccgaatttctaaggcagccggccagggggaatccgctggacagtcagcggagctgatcgccagagacactcccgaaccttgggagggttttcgcaatgatataagtgcacagattgctaggatcgtggttagccaccgtgccgaccacggccggatcgatgtggaagggagaaaacatggaaaggactccaccgccggcaggctccacaacgacacagcttacggtattgtcgatgaccataccgtggtatctcgcactccactgcttagcttgaaacccggggatatcgaggtgacaacgaagggcaaaaatattcgagacacccaactgcagaaggcattatcagttgccactacaggaaaggatggcaaagggttcgaggaagcgctcagaaactttgctgagaaggaaggaccttatcagggcatacggagggtccgcctgatcgagacccttcagagttccgcccgtgtggaagtgggtagcgacgaggatgggcaaccactgaaagcatacaagggagactctaatcactgctatgatttgtggaaactccccgacggcaaggtcgttccgcatgtggtgtcaacatacgaggcccacgctggtactgataaaagacctcacccagcagccaagcggattctgagggtattcaagaaagacatggtcgcgatcgaacaggacgatcagaccgctatcttttatgtgcagaagctagaccgcgccaacggcctgttcctcgcaccccatctggaggccaatgctgatgcccgacacagaaaccctaatgacgcatttaaattccttcaaatgggggctggaagtgttgtgcggaacaagttgaggcgcgtctacgtggatgaaattggcagaataaaagaccccgggccacctaagcattga

SEQ ID NO: 2581 - RNA, 2994 nt, synthetic construct
  misc_feature 1..2994: note = Cas9 variant
  source 1..2994: mol_type = other RNA
atgaagatactgggcttcgacattgggataaacagcatcggatgggcctttgtggagaatgatgaactcaaagactgcggtgtcagaattttcaccgaggctgaaaacccctccaataaggagtctcttgcactgcctaggcggaacgcccgctcaagtcgacgtagattgaaaaggcggaaggcgcgcttagttgctatcaaaaggattctggccaaggaactaaagctcaattttaaagattacgtggcagccgacggcgagctgccaaaggcttatgaggggaaacttacaagcatctacgaactgagatataaggcattgatacagcaactcgagactaaagatctggcccgggtaatcctgcacattgctaagcatcgcggatacatgaacaagaatgagaaaaagtccaacgacacgaaaaagggcaaaatcctctctgccttaaagaataacgcgctgaaacttgaaaattatcagtcggtgggtgagtacttctataaggaatttttccagaagtacaaagagaacaccaagaattttattaaaatccgaaacacaaaggataattacaacaactgtgtcttgtcaagcgacctggaaaaagagctaaagctcatactggaaaagcagaaagagttcgggtataattacagtgaggattttattaacgaaatccttaaggtggcattctttcaaagaccgctgaaagacttctcccacttggttggagcctgcacctttttcgaggaagagaagagggcttgtaaaaattcttatagcgcctgggagttcgtggcactcaccaagattatcaacgaaatcaagtccctggagaaaatttcaggcgaaatagtccccacacagaccatcaatgagattttaaacctgatcctcgataagggcagtataacttacaaaaagtttcggagctgcattaatcttcatgaatctatctccttcaaatcactgaagtatgacaaggagaacgctgaaaatgccaaattgatcgattttcgtaagctagtggagttcaaaaaggcgctgggggtacacagcctcagtcgccaggagctggaccagatttctacacatatcacccttattaaagacaacgttaagctgaaaacggtgttggaaaagtacaatctctccaacgagcaaataaataacctgttagaaatcgagtttaatgattatattaacctgagcttcaaggccctaggaatgatcctccctctgatgagagagggtaaaaggtactacgaagcatgtgagatcactaaccttaagccaaaaaccgtcgacgaaaaggaggactttttgcccgctttctgcgattcgatttttgcccacgaactgtctaatcctgtggtgaaccgggctatatccgagtatcgaaaagtcctcaatgccctgcttaagaagtacggcaaagttcacaagatccatctggagttggcacgcgatgtggggctcagtaaaaaggccagagagaaaattgaagaccagcagaagaacaataaggctatcaacgattgggcgctgaaagaatgtgagaatattggaatcaaggcatcagccaaaaacatattaaagctgaaactatggaaggaacagaaggagatctgcatttatagcggcaataaaatctccattgagcacctcaaggacgaaaaagctctggaggtagatcatatctacccatattctaggagcttcgacgattcatttataaacaaggtgcttgtcttcacaaaagaaaatcaagagaagttgaacaaaactccctttgaagccttcggtaagaatattgagaagtggagtaaaatccagaccctggcacagaacctcccttacaagaaaaagaataaaattctggacgagaacttcaaggacaagcaacagcaggattttatctcccggaacttaaatgacacacgctatataaccacgctgatcgccaaatacactaaggaataccttaacttcttgccactcagcgagaatgaaaacacaaatctgaaatctggggagaagggatcaaaaattcacatccagaccattagtggcatgctaactagcgtgctgagacacacatggggctttgataagaaggacaggaacaatcatctccaccatgctctggatgccatcatagttgcatattccacctcttcgattatcaaagcgttcagcgactttaagaaaaaccaagagcttttgaaggctcgtttctacgccaaagaactgacgtccgataattataagcaccaggtgaagtttttcgagccgtttaaagggttccgggaaaagatcttatcaaaaattgacgagatctttgtcagtactccccctcgaaagagagcaaggggagccctccatgaagagacattctactctgaggataaaatgattaagaagtataacagcaaagaaggtctgcagatagctctttcctgtggccgcgtgcggaagatcgggactaaatacgtagagaatgacaccatggttagagtggatatttttaagaaacagaacaagttctatgccatcccaatttacgtcatggacttcgcactgggaatcttgcccaataaaatagtgatcacaggcaaggataagaacaataaccctaaacaatggcagactattgacgaatcatacgagttttgcttcagcctctataagaacgacctgatcctactgcagaaaaagaatatgcaggaaccagagtttgcttactataactctttcgatattgacaggtcccgcatcaaaataaagaagcacgataataaatttgagaacctcaccagtaatcaaaagctgcttttcacaaacaaagacaagggtaaaaatcgaaccgggattcagaacttgaagatctttgaaaagtacatcgtcactcccctgggcgataaaattaaggccgacttccagccgcgggagaatatcagcttaaaaacgtctaagaaacacggactctga

SEQ ID NO: 2582 - RNA, 2994 nt, synthetic construct
  misc_feature 1..2994: note = Cas9 variant
  source 1..2994: mol_type = other RNA
atgggcaactacaccctggggctcgacatcggaagcaattccattggttgggcccttgtggaggatgctgtcgaagcacccagaatagttgacatgggcgtgagggtattccctgagggggtggatcgggacacaaagggactggaaaaatctaagaacgccactcgccgagaggcgcgtggcgctagaaggacgcaccagcggcgcagacaaaggaaacagcggttggtccgcgccttacgacaggtgggtctgctaccatgcgataaggcagaagttagatcactctttcagaccgacccgtatgagatcaggaaacgggggctggatcatcgtcttgagctgtacgaaattggacgcgccttctatcacttgagtcaaagaaggggctttaagagcaatcggaagtccggcgctctcaaagaggacgggacagtgaagaaagaagcaggagagctgcagcgaaagatcgatgaggccggttgtcgcactattggcgaatacttcgctgggctggaccccgagcagcagagaatcaggggacggtatacctttcgctctatgtaccaaaaagaatttgatctcttatgggccaagcaggtcgagttttatcctaaggtgctgacagaagaccttagatcgaaagtaagggatgagataatcttctttcagcgtccattgaagtcagcgaaagacctgattggcgactgcgagctagaacccaccgagaagcggtgtcctcgagcagattggtacgccagaaggttccgcctcctgcaggacatcaacaatcttattatccaaaacccagatggtactgaacagaaactgagccccgaccagcgggctgccttgctcggggagctgggacaaagagaaaagttaacatttgataatataagggcaaaactgggcctccttgagacccagaagttcaacgctgagtaccgcattggccgaaaggggaaaaaggttgaagccatcaaaggagacgtgtttgtctggacgatgcggggtaagagtgtgttcggccctaaagcgtgggatgccatggcagacgagcgtaaggtgtccctgaatgaattgttcgtcgagctagaagatgacgatctggctagaaagctcgagactgagtatgggctgaccgacaaacaggttcaggccgctatgaaggcctctcttccacaaggatacatgagcttttccaggaaagcagtgctgaagttgctcccgttcatggaagccggcgctctgacacatgaggcgattgaccaggcaggttatcgcaaagaggaacccactcagaccgatgccatcgctcgggtatcatttcctccagacttaagaaaccccatcgtgcagaaggccctgttcgaggtcaggaaggtggttaatgccctagtgcgagaatacgggaaacctacacgcattaagatagagatggcacgggatgtccaaggcagtaaaagacagagggaggaactccactggcgtaacgaagacaatcgcaagaaaaacgaggaggtgcgggatagactgaggaccgacatccatattgatgacccaagccgagatgacgtaatcaagtataaactttggcaggaatctggaaaaatgtgcccctacacgggccggcagatatgtcaagaggctttgtttgggccgaatcctgagttccaggttgaacacattctgccctatgatcgctccctcgacgattcatacatgaacctgactctttgcgaagtgcacgagaacatccatggaaagagaaatcagacaccatttgaggcctacggtagcggcgcagaaaggtatgagcagatcaaacaacggattaaggtcctgccttggcccaaacgacagaagttcttgcagcaagaaatcaacctcgacagtcacatttctagagagctgaatgacacccgctacatatgtagggaaactgtggcgtatttaaaacagctgggggtccatgtgcgtggaacacggggcaagatcaccgctgagctaagacaccagtggggtctcgatgggattttctccgagctgggcgttaggcgcgacgatgaccaccgaagacatgccgtggatgcacttgtagtcgccgtgacggacaacgaacacttgcggaggctggctgttagcaagtacgtgctcgccggaccacgcttcgagaccccctggtcggcatttcgtgatgaagctagaggcaatgtcaaacggatgaacgtgtctcatagggtatgccgcaaggtgtccggggccctgcacgaggagacaaattatggacctactggtgttcgagaccaggcgggccaagatatctacgcctatagaaagaagttagaagacctgaccacaccaatggtcgagaaaatcgtggatccggtggtccgggacattgttaggcagcgccttttgatgaaggggatagatcccgctgcagccgacagaaagatccctaaagacgtgtggaaggaaccactctacatgaggcggactaaatcagataagatgattcagatccgtcgcgtgcgaatccatgacgtcaaaaacagtattatagtactgaccgatgagagcggaagaccctacagggctgtggaacctggcggtaatcaccacgttgaggtgttcgagtatgtccatgggacaaagaccggcactcgggaagccgaggtggttacgatgtttgaagcagtgcgcagatccagggcgcgggccccagtagtccgaagagaccacggacccggcacacgcttcgtgtgttctctagctatcaacgatatggtgatgatgccggacaagagcgggaaaatggatctgttcaggattcagaagatgtcagccagtaaacaagtctactttcggcatcacaccgcagctcgtatcgactccgagagaactctcattaggaagcaggcccacctgttcaatggatataaagttagcgtggatcctaccggcgcaatctgccgcgccaacgactga

SEQ ID NO: 2583 - RNA, 3000 nt, synthetic construct
  misc_feature 1..3000: note = Cas9 variant
  source 1..3000: mol_type = other RNA
atgaagatcctgggcttcgacattgggataaacagcatcggatgggcctttgtggaggataatcagctccaagactgcggtgtcagacttttcaccaaagctgaagatcccaagacaaaagagtccctggcattgcctaggcggaacgcccgctctaatcgacgtagattaggcaggcggcgctcaagactgattgcgctaaagcacatcattagtaaagggctcaagctgaactaccaggactatatcgctaatgatggagaacttccaaaggcctacgagggcaggctgataagcccgtatgaattgcggtacaaagcactcaacgagaagatcgagcccaaagacctggcccgcgttattctgcatatcgctaagcaccgaggttatatgaataaaaacgaaaagaagtcctctgataatgagaaagggaagattctctcggcattaaaaactaacgccctgaaacttgaaaagtaccagtcagtgggagagtatttttacaaggagttctttcagaaatacagagaaaatacgaaggacttcatcaacataaggaataaggagggcagctatgaaaactgtgtattggctagtgatctggagaaagaactaaagctcattctggagaaacaaaaggagtggggctactcctataatgacaactttatcaaagaaattcttaaggtggccttctttcagcggcctctgaaggatttctcttacttggtcggggcgtgcacctttttcgaggacgaaaaacgtgcatgtaagaacagctattccgcctgggagtttgtggctctcacaaaaatcatcaatgaactgaagtcattagagaaagagagtggagaactggttagctctcagattataaacgagatcctcaatcatattcttgataagggttccatcacttacaagaaattccgcgaatatataaagctgcacgagtcaatgaaattcaagagcttgaaatacgacaaggacaacgtggaaagtaccaagctaattgagtttagaaaactggtcgagttcaagaaagccctcggcgaacattctctgtccagggaggaacttgatcagatcgcaacatacatcaccctgattaaggacaatgagaaattgaagatcactctcgagaaatatagcctgaacaatgaacaaattaagaacttactggagatagattttaatgaccacatcaacctatcgttcaaggctctcaatctgattcttccattgatgaaagaagggaagcggtacgatgaggcctgcaaactgctcaacctgaagacaaaatctaataaccagaagtttgacttccttcccgcgttttgtgattccatcttcgcccaggaactgaccaatcctatcgtgaaccgagcaatttcagagtatcgcaaggtattgaacgctctcctgaaaaagtacggaaaaatgcacaagatacatatcgagttagccagagacattggcctgagtaaaaagctaagggctaagatcgaaaaagagcagaaggaaaattatgagaacaatatttgggccctcaacgaatgcgagaaatttggtctgaaggcaaatgccaaaaacatccttaagttgaagctgtggaaagagcaaaaggagttctgtatatacagcgggaaaaagatctccattgaacacctccgggatgaaaaagctctggaggttgaccatatctatccatactctcgcagctttgatgactcattcttaaataaggtgctggtctttacgaaagaaaaccaggagaaacttaataagactcccttcgaggcgttcggagcaaacgaagagagatggagtaagattcaggccttggctcaaaatctcccttacaagaaaaagaacaaaatcctggacgaagcctttaagggcaagcagcagcaggatttcatatccaggaatctaaacgacacccgttatattagcacactgatcgtgaaatacactaaggagtatctcgattttctgccacttgacgagaaagaagatgtgaatttgaagtctggcgagaaagggtcaaagattcacgtccaaaccatcaacggaatgctgacaagtgttttacggcacacctggggtttcgcacagaaggaccgaaacaatcatctccaccatgccctggatgctacgatagtggcctacagcactaacgcaatcattaaagcgttttccgacttcaagaaagaacaggagcttctgaaggctaaattgtatgccaaggaactcacatctgattcgtacaagcaccaggcaaaatttttcgagccgtttgagggcttcagagaacaaatcctgaatcagattaacaagctatttgtaagcaaaccccctaggaagcgcgcccggggagctctgcataaagagaccttctattccaaggacgaaatgatcaagaaatacaattcacaggagggagtggaaatagccctcaactgcggcaagattagaaaaatcggtactaagtacgtcgagaatgatacaatggtgaggatcgacatttttaaaaagcagaacaaattctatgcaatcccaatttacaccatggatttcgctctgggggttcttcccaataagatagtgatcattggcaaggacaaaaagggaaaccctaaacaatggcaggagatcgacgaaagttatgagttttgtttctctttgcacaaggatgacctggtcttaattcagaaaaaggatatgcaggaaccagagtttgcctactataatggcttcgacatcagcaactcctcaatatgcgtggaaaagcacgataataaatttgagaacctcacggacaatcaacgcctgcttttcaccaacgcggaggggaacgtaaaggccaaaaagatcgggattcagggtctgcgaatctttgaaaaatacattatcacacccctaggcgagaagataaaggctgatttcaaaccgcgggaagacattgcactcaagactagcaaaaagcatgggctgtga

SEQ ID NO: 2584 - RNA, 3003 nt, synthetic construct
  misc_feature 1..3003: note = Cas9 variant
  source 1..3003: mol_type = other RNA
atgaagatcctgggcttcgacattgggataaacagcatcggatgggcctttgtggagaatgatgaactcaaagactgcggtgtcagaattttcaccaaggctgagaaccccaaaaataaggaatcccttgcactgcctaggcggaacgcccgatcttcacgccgtagattgaaaaggcggaaggcgcgcttaatcgctattaagagaatcctggccaaagagctaaagctcaattttaaagattacgttgcagccgacggcgaactgccaaaggcttatgaggggagtcttgcaagcgtgtacgagctgaggtataaagccttgacacagaagctcgaaactaaggatctggctcgggtaatactgcacatcgccaaacatcgcggatacatgaacaagaatgagaaaaagtccaacgacgcgaaaaagggcaaaattctctctgcattaaagaataacgccctgaagttggaaaattatcaatcggtgggtgagtacttctataaagagtttttccagaagtacaaagaaaacacgaagaattttatcaaaattcgaaacaccaaggataattacaacaactgtgtcttgtcaagcgacctggagaaggaactaaaattcatcctcgagaagcagaaagaatttgggtataagtacagtgagggattcataaatgagattctgaaagtggcctttttccagagaccgcttaaggatttttcccacctggttggcgcttgcacattcttcgaagaggaaaacagggcatgtaaaaattcttatagcgcttgggagtttgtggccttgactaaaatcattaacgaaatcaagtccctcgagaaaatctcaggcgagattgtcagtacccaaacaataaatgaagtgctgaacttaatcctggacaaggggagcattacctacaaaaagttccggtcttgcatcaatctccatgagtccatatcatttaagagccttaaatatgataaggaaaacgcggagaatgccaaactgattgacttccgtaagttggtagaatttaaaaaggcactaggagttcacagtctgtctcgccaggagctcgatcagatctccactcatgtgacactgatcaaagacaacgtcaaacttaagaccgtgctggagaagtacaatttgagcaacgaacagattaataacctcctggagatcgagttcaatgactatattaacttatcgtttaaggctctgggtatgatactacccctcatgagagaaggcaaaaggtacgatgaggcctgtgaaatcacgaacctgaagcctaaaactgtggacgagaagaaggatttccttccagctttttgcgactctattttcgcccacgaattgtccaatcccgtcgttaaccgggcaatctcagagtaccgaaaagtgctgaatgccctcctgaagaaatatgataaggtacacaaaatccatcttgaactggctcgcgacgtggggttgagtaagaaggcgagagagaaaattgagaaggaacaaaaagagaaccaggcagtcaatgcctgggctctcaaggaatgtgagaacataggactgaaagccagcgcaaagaatatcttaaagctgaaactatggaaggaacagaaagagatttgcatctactccggcaacaagatttctatcgagcacctcaaagatgaaaaggccctggaggtggaccatatatatccttacagcaggtcatttgatgacagtttcatgaataaagttcttgtgtttaccaaggaaaaccaggagaagttgaataaaacaccattcgaggctttcggtaagaacatcgaaaaatggtccaagattcaaactctggcccagaatctcccctataaaaagaagaacaaaatcctggatgagaattttaaggacaaacagcaagaagacttcattagccggaacttaaacgatacccgctacatcgcaacactgataaccaagtatacgaaagagtaccttaattttcttcctctcaacgaaaatgagaacactaatctgaagtctggggagaagggatcaaaaattcacgtccagacagtgaacggcatgctaaccagtgtactgagacacacttggggcttcgacaagaaagataggaataaccatctccaccatgcgctggacgctatcattgttgcctacagcacaaattccatcataaaggcattttctgatttcaaaaagaaccaggaacttttgaaggcccgtttttatgctaaagagctgacctcggacaattacaagcaccaggtgaaattctttgaaccattcaaggggtttcgggagaaaatcttaagcaagattgatgaaatcttcgtctccaagccgccccgaaaaagagccaggggagcactccataaggagacgttttattcagaggacgaaatgattaaaaagtacaacagtaaagagggtctgcaaatcgctctttcttgtggccgcgtgcggaagatagggaccaaatatgtcgaaaatgatacaatggtgagagttgacattttcaagaagcagaacaaattctacgccatccctatctatgcgatggattttgccctgggaattttgccaaataagatcgtggtagtcggcaaagacaagaacaacaatcccaaacagtggcagactattgatgagagctacgagttctgcttttccctctacaagaacgacctgataatgctacaaaagaaagacatgcaggaagctgagttcgcatattacaatggttttgatatctcaaccagctctatttgtgtggaaaagcacgactccaaattcgagaacctgacaagtaatcagaagctcctgtttagcaacgccaaagaagggtctgttaaggtggagaatcttggcatccagaacttgaagattttcgaaaaatatatcataactcctctgggagataagatcaaagctgactttcaaccaagggagaatatttccttaaagacctcaaagaagaacggcctctga

SEQ ID NO: 2585 - RNA, 3003 nt, synthetic construct
  misc_feature 1..3003: note = Cas9 variant
  source 1..3003: mol_type = other RNA
atggccagagctcagaggcggctgatcagccgccgagcaaaccgtatgaataagctcagaaggcttctgaaacaagagaacgtgttgcaggccaatgactacgatgaaaagggcttaattatagggctgcccaaccaggcgtgggagctacgggctcagggactcgaccgcaaactggaacctaaggagtgggccgcagtccttatcaatctggttaaacacagaggttatttgtcccaaaggaagaacgaatctcagaccgccgataaggagctcggcgctctgctgtcagggatgaatcataaccaccagctcttacagagtcaaagcaatcagtaccggacaccagcagagctggccattaaacagttcgctactcaggacggacatatccgcaaccaacgaggcgcctatacgcacacctttaatagacttgatttgcagaacgaactgaatcagctattcgacgcgcaaacaaggctcggtaacccgcatgtgtccgggtctctgaagactgcaattaatgatcttctgatgaaccagaaagccgctttgtcgggagacgccatcctcgagatgctgggccggtgcacctttgaaccctcagagtacaaggcagctaaaaacacatatagcgccgagcgtttcgtatggttaggcaagctgaccaatctccgcatacaggataacgggcttgaaagtgcgctgtccagagagcagagggaattgctactgaatgagccttacaacaagactaaactcacatatcaacaggtgcggaagctgcttcgactgccagaaaccgcctttttcaaaggattgcgctacggtaaggacaatgcagagtctgctacgtttatggagatgaaaagctaccacgccatcagaaagtccctcgaaaacaaatcactgaagagtgagtgggaaaagttaaaaactcagcccaagctgctagatctcattggcaccgctttcagcatctataaaacagacgatgagattgccgggtgtctgaagaatcagcttcctgaaaacgtcatcatagcattgcaagagcagctgaatttttctaacttcatggagctctccctgaaagcccttgaaaagctgttgccactcatggagcagggactgaggtacgacgaggcttgcactcagatttatggcaatcggcacgaaaagatcgcggacaaaaccgaaaagtttttacccaacattcctgcagataaactgcgcaatccagtggttctaagaacactcacccaagccaggaaggtgatcaacgctatcattcgtcggtacggttcaccggcccgagtccatatagagacggggagagaggtgggaaagagcttcagtgacagggataagctgaagaaacagcaggaagagaatcaggaacaacgccggagagcaatcgacgagtggaagcagtttttccccaacgccgctcacgagcctaaagccgtagatattcttaagttgaggctgtatcagctccaacagggcaaatgtctgtactctggcttaccaatcgacgttcgccgactgcccgaaaaggggtatgtggagatagatcatgcacttcctttctcccggacttgggacgatagctttaacaataagattttggtcctcgcgtcggaaaaccagaataaaggaaaccagacaccatacgagtacctgcgtggtgctgacaattctgaatcctggagactattcgtggagaacgtgcaaaattgccagttttcacccaacaagaaacagaagatcatggccaaacagctggatgagaagggcttcctcgaaaggaatctgaacgacacccgctatgtcagtcggtttctttgtcaattcatcagcgagcacttgcacctgactgggaaaggaaagaagagagtttttgcatccaatggccagattacagccttactcaggggtcgatgggggctgtctaaaaaccgcgaagagaatgaccggcatcacgctgtggatgccgtagtggtcgcatgcagcaccgtggctatgcagcagaagatcacgcaattcgttagataccagaaaggcaacgtgtttaccggagaaaggattgacaaggagacaggcgaggtcatatcaatccatttcccgactccttgggaacactttcgtgaggaagtgatgattcgcgtattcgatgacaatccccttcggaccctgccagagaaattgcctaacagacccgaagccctccatgagtatgttatgccactgtttgtgagtaggatgcccacacgaaagatgactgggcagggacacaaggagaccatcaaatccgcgaagcggctagatgagaaaatcagcgtcctgcgcgtgcctctcacacaactgaaacttaacgacttggaaaatatggtcaacagagaaagggagccagccctgtacgaggctttaaaagcacggctcgaacagttcaagaatgatccggccaaggctttcgccgagccctttttcaaacagggtggccagcaagtgaaggcagttcgagtggaaattgtacagaaatctgggatgctgcttagaaagataaacggagtcgcggacaatggctcaatggtgcgcgttgatgtgtttgagaaaagtggtaagttctatctggtccctatctacgcctggcaagtggctgaagggattctaccaaactatgccgtagtggcacacaaggacgagagcgattggatcctcatggacgagtcctaccattttaaattcgctctgtacaagaatgatttgctggaagttcagaccaaaaagggcggaattatgggctattttgcctctttagacagggcaactggggccatcacgatacgtgagcacgaccgggataaaaagaaatgtaaggacggagaacatagatcgatcggtgtcaagatggctagctccttcaaaaagctccaggtggatgagctgggcaaaaacattcacgaaacaaggtcacgcaagcgacccaatatcgggtga

SEQ ID NO: 2586 - RNA, 3012 nt, synthetic construct
  misc_feature 1..3012: note = Cas9 variant
  source 1..3012: mol_type = other RNA
atgagaatcctgggcttcgacattgggataaacagcatcggatgggcctttgtggagaatgatgaactcaaggactgcggtgtcaggattttcaccaaagctgagaaccccaagaataaagaatcccttgcactgcctcggcgcaacgcccgatcttcacgtagaaggttgaagcggcgcaaagcgagattaatcgctattaagaggatcctggccaaggagctaaaactcaattacaaggattatgttgcagccgacggcgaactgccaaaggcttacgaggggagtcttgcaagcgtgtatgagctgcggtacaaagccttgacacagaacctcgaaactaaagatctggctcgcgtaatactgcacatcgccaagcatcgaggatatatgaataagaacgagaaaaagtccaatgacgcgaaaaagggcaaaattctctctgcattaaagaacaatgccctgaaacttgaaaactaccaatcggtgggtgagtatttttacaaggagttctttcagaagtacaaaaagaatacgaaaaacttcatcaagattagaaataccaaagataactataacaattgtgtcttgtcaagcgacctggaaaaggagctaaagctcatcctggaaaaacagaaggagtttgggtacaactatagtgaagatttcataaatgagattcttaaagtggcctttttccagaggccgctgaaggacttttcccacttggttggagcttgcacattctttgaggaagagaaacgggcatgtaagaactcttacagcgcttgggagttcgtggccctcactaagatcattaatgaaatcaaatccctggaaaagatctcaggcgagattgtccccacccaaacaataaacgaggtgttaaatctgatcctcgataaaggcagtattacctataagaaattccgtagctgcatcaaccttcatgaatctatatcctttaagtcactgaagtacgacaaagagaatgcggaaaacgccaagttgattgatttccgcaaactggtagagtttaagaaagcactaggggttcacagcctcagtagacaggaactggaccagatctctactcatatcacacttattaaggacaatgtgaaactgaagaccgtcttggagaagtataacctctccaatgagcagatcaacaatctgttagaaattgagttcaacgattacataaacctgagctttaaagctctaggaatgatcctccctctgatgagggaaggtaagcggtacgacgaggcctgtgagattgctaatcttaaaccaaagacggtggatgagaaaaaggacttcttgcccgccttttgcgattcgatcttcgcacacgaactgtctaaccctgtggtcaatcgagccatctccgaatatcgcaaggttctcaacgctctgcttaaaaagtacggcaaagtgcacaagattcatctggagttggcgagagacgtagggctcagtaaaaaggcaagggaaaagatagagaaagagcaaaaggaaaatcaggccgtgaacgcttgggccctgaaagagtgtgaaaatatcggattaaaggcatcagccaaaaacattctgaagctaaagctctggaaagagcagaaggaaatctgcatttatagcggcaataaaatctccatagagcacctgaaggatgagaaagctcttgaagtcgaccatatctacccatattctcggagctttgatgactcattcattaacaaggtgttggtttttactaaagagaatcaggaaaagctgaacaagacccccttcgaggcctttggtaaaaatatcgaaaagtggagtaaaattcaaacactcgcacagaacctgccttacaagaaaaagaataagatcttagatgagaacttcaaagacaagcagcaagaggacttcatatcccgcaacctgaatgatactagatatattgcgacccttatcgctaaatacacaaaggaatacttgaactttctcctgctaagcgagaatgaaaacgccaatctgaaatctggggagaagggatcaaagattcacgtgcagaccatcagtggcatgctcacgagcgtcctgaggcacacttggggcttcgacaaaaaggatcgtaacaatcatcttcaccatgcattggacgccataatcgtggcttattccacaaactctattatcaaagccttttcggatttccggaagaatcaggagctgttaaaagcacgattttacgctaaggaactcaccagcgacaactataagcaccaggtaaaattctttgagccattcaagtcctttagagagaaaattctgtcaaagatcgatgaaatattcgttagtaaaccgcccaggaagcgcgcccggagagcgcttcataaggacacttttcactctgaaaataaaattatcgataagtgtagctacaactccaaagaggggctgcaaatcgccttgtcatgcggaagggtgcgcaagattggtacaaaatatgtcgagaatgacaccatcgtgcgagtcgatattttcaagaaacagaacaagttttacgctatacctatctatgcaatggacttcgccctcggcattctgccaaataagatcgtgattacggggaaagataagaacaacaatcccaaacagtggcagaccatcgacgaaagctacgagttctgtttttctctatacaagaacgacctgatactcctgcagaaaaagaatatgcaagaacctgagttcgcttattacaacgatttttccatcagtacaagctctatttgcgttgaaaagcacgacaataaattcgagaaccttacttccaatcagaagttgctgttttcaaacgccaaagagggaagtgtgaaggtagagagcttaggcatccagaatctcaaagtcttcgaaaagtatattatcaccccactgggtgataagataaaagcagactttcaaccccgggaaaacatttcgcttaagacatccaaaaagtacgggctgcgttga

SEQ ID NO: 2587 - RNA, 3012 nt, synthetic construct
  misc_feature 1..3012: note = Cas9 variant
  source 1..3012: mol_type = other RNA
atgatcgacgagagcctgaccttcggcattgatctcgggataggatcctgcggttgggccgtgcttagaaggccctctgcttttggccggaagggggtcatcgaaggaatgggctcatggtgtttcgacgttcctgagacaagtaaagaacgcactccaacgaaccagattcgacgtagcaatagactgttgaggcgggtgatccgcagaaggcggaaccgcatggcagccattcgaagattactgcacgcggctggtctactcccgtccaccgattctgacgccctgaagaggcccgggcatgatccttgggagcttcgggcacgtggactggacaaaccattgaagcccgtagaatttgccgtggtcctcggccacatcgctaaacgcagaggcttcaagtcggcagccaagaggaaagctacaaatatatcaagcgatgacaagaaaatgctgactgccctggaggcgacccgggagcgactcgggcgctacagaacagtgggagaaatgtttgcaagggatcctgacttcgccagtcggcgcagaaacagggagggtaagtatgatcgtaccactgctcgggacgatttagaacatgaggttcacgccctgtttgcagctcaacgaagacttggccaggggttcgcctccccagagttggaagaggcgtttacagcctctgcattccatcagaggcccatgcaggacagcgaacgcctggtgggattttgccctttcgagcggaccgaaaaacgggctgccaagctaacgccatcctttgagaggttccgcctcctggctcgacttctgaatttgcggatcactaccccggacggcgagcgtcccctcacagtcgatgaaattgccctggtgactagagacttaggtaagaccgcaaaactgtcaatcaagagggtacgcacactcattgggcttgaggataaccaacggttcaccacgatcagacctgaagacgaggatagggacatagttgcccgaactggaggcgctatgacaggcaccgcgactctgcgcaaagcattgggggaagccctatggacagatatgcaggagcggccagagcagctggacgctattgtgcaggtcctcagctttttcgaagccaatgagaccatcacggaaaagctgagagagattggacttaccctggcagtgttggatgtgctcctgacagccttagacgctggtgtctttgccaaattcaagggcgcagcgcacatcagcactaaagctgccaggaacctgctaccccacctcgaacaagggcgtcgctacgatgaggcatgtaccatggccggatatgaccatgctgcctctcggctgtcccaccatggccagatcgttgcaaagacacagtttaatgctcttgtgactgagattggtgaatcaatagccaaccctatcgcgagaaaggccttgattgaggggctgaaacagatctgggctatgaggaatcactggggcctcccaggaagcatacacgtagaactggcacgagacgtgggcaacagtattgagaagcggcgcgagatcgaaaaacatatcgagaagaataccgcccttagagctagggaacggcgagaggtccacgatctgttggacctcgaagatgtgaacggggacacactgttaagataccgcctgtggaaagagcaaggaggtaagtgcctatataccggcaaggccattcatatcaggcagattgcagcgactgataattctgttcaggtggaccacatactcccctggtcccgtttcggggatgacagctttaacaacaaaacgctgtgtcttgcctcggctaatcaacagaagaaacggtctacaccgtacgagtggttgtccggacagaccggcgatgcctggaacgcattcgtccagagaatcgaaactaataaggagctgaggggttttaaaaagcgcaactatctcctgaagaatgctaaagaagccgaggaaaagttccgatcaagaaacttaaatgacacccggtacgcagccaggctgtttgctgaggcggtgaaacttttgtacgccttcggggagcgccaagaaaagggcggaaaccgtagagtatttacacggcctggcgcactcaccgctgccctgaggcaggcctggggagttgagagtctgaaaaagcaggatgggaagcgcattaatgacgatcgacatcacgctctagacgcactcactgtggccgcggtcgacgaagctgagatccagagactgacaaaaagtttccacgaatgggagcaacagggtcttggccggcccttgaggcgcgtggagccaccttgggaatccttcagagccgatgtcgaggcaacgtatcccgaagtgtttgttgccaggccagagcggcgtcgcgctcgaggggagggacatgcagccaccatcagacaggtgaaggaaagggagtgcactcccattgtattcgaacggaaagcggtctctagcctgaaggaggctgacttagaacgcataaaagatggcgagagaaacgaggccatcgtggaagcaattaggtcatggatcgccacaggtcggcctgctgacgccccaccgcgaagtcccagaggggatattatcaccaagatacgcctcgcaacaactatcaaagctgccgttcctgtgaggggcggaaccgcgggcagaggggagatggtccgtgccgacgtgttttccaagccaaatagaaggggaaaggatgaatggtacctggtacccgtgtatcctcaccagattatgaaccgcaaagcatggccaaagcccccgatgcggagcatcgttgctaataaagacgaggatgaatggacggaggtcggccctgagcatcaattccgattttctctttacccaagatcaaacattgaaatcataaggcccagtggtgaggtgattgaagggtatttcgtgggactgcaccgcaataccggcgccttgatccctacacccgtcggtccagacagctacgttattgcttga

SEQ ID NO: 2588 - RNA, 3024 nt, synthetic construct
  misc_feature 1..3024: note = Cas9 variant
  source 1..3024: mol_type = other RNA
atgaaggtgctgggcttcgacatcgggattaacagcataggatgggcctttgtcgagaataacgaactcaaagattgcggtgttagacttttcaccaaggctgagaatcccaaaacaaaggaatccctggcattgcctaggcggaacgcccgatcttcacgagtgcgtttaagaaggcggcgcagtagactgctaagcctcaaacacatcatttccaaggagtttggcctgcattacgaagactatatcgcgcttgatgggaatctgccaaaggcttacactggaaaaattgagtctatctataagttgaggtacgaggccctctcgcaggcaatatcaaaagaagacctggcccgggtaatcctgcacattgctaagcatcgcggctatatgaacaaaaatcaaaagacgagccaggatagtgagaagggtgcaatcctctccgccattaaagaaaactctaataagatcaaacactaccagaccgctggggagtatttctacaaggagttatttgaaaacctgcgagacggaacaaaagagttcaagaatataagaaacaaagccatgaagaatgaaaagactggcaacatggagagcacctactataatacaattcttgcgtccgatttggaaaaagagctgaagctaatcctcgagaaacagcaagcataccataactattcagacacctttattaaggaagtgctggagatcgccttctaccagaggccgcttaaagattttagtcacctggtcggcagctgtactttctatgaaaacgagaagcgggcttgcaaaaattcttactccgcctgggaatttatcgcattggggaaaattataaacacactcgagtcaatcaagaaagacaccggagagattttcagcaatgaaatcataacgcagattctgaaggaggtgttagataaaggtagtctgtcttatactaagctccgtaagatgatcaaccttgacgaaaaagttaagtttaaaggcctgaagtacgataaagagggggtggaaaagaccaatttgatcgagttcaagaaactaaaggagttcaaaaaggctctgggagaacacaacctcgagcgcaaaacactggacgaaattgccactcatatcacccttacaaaggacgagaatcagctgaaaaagcaattggagcagtacgcgctctcccagaaccagattgatgccctggcagaattagactttaatgatcacataaacctgagcttcaaggctctatatgagatcctccccctgatggaaaaaggcaagagatacgacgaggcctgtaatgaacttggtttgaaagctaagacctcgaaccaaaaatctgagtttctgcctgccttctgcgattccatttttgcacaggagctcacgaatccaatcgtcaacagggccatctcagaatatcggaaggtgctgaatcgacttctgaagaaatacgggaagatgcataaaattcacatagagttggctcgcgacgcgggactcagtaaggaagcaagaaacaaaatcgagaaggaacagaaggagaacaaagatattaatgacaaggccgagaaaacttgtaaggagttcggcctgaaacccaacgctaagaatatcttaaagattaaactgtggagggaacaaggcgaaatctgcgcctatagcgggaagaaaataacaatcgatgacctaaaggaggataaagcactcgaagtagaccacatttacccttattcccggtcttacgacgatagctacaacaataaggttctggtgtttatcaaagagaaccagcttaagttgaatcagaccccatatgaggccttcggatcaaaccaggaaaagtggagtaaaattcaagtcctggctcagaagctcccctacaaaaagaaaaatcgcatcctggacgagaactttaagaataaggatcagatagagttcatttccagaaacttaaatgacactaggtatgccacaagcctgatcgcaaaatacaccaaggaatatcttgagtttttgcctctctctgatgacgaagatatttcactgaaaagtggtgagaagggcagcaaaacgcatgtgcagaccatgaacgggatgctaacatccgtgctgcgtcacgcgtggggattctctcaaaaggaccggaataaccatctccaccatgctctggatgccatcataatcgcatactcgactaacagcattatcaaggccttttccgacttcaaaaagaatcaggaaattcttaaagctaagttgtatgccaaaaagctgacctcagaggaatacaagaaccagagtaaattcacaggctttgagaagtaccgatctaaaatcttagagaagctcgatagcatattcgtctccaaaccaccgaataagaacactaagggtgcactgcacgaacagaccttttattcataccaagacattcttgaggaatataaaacacaggaggggctgaagagagctttggaatgtggcaaagttaggaagatcggaaccaaatacgtggtaaatgatcgcatggtgcggctcgacatcttcaagaaagacaacaagttttatggcattcccatctacactatggatttcgccctgggggtcctacctaataaggtggttacgattggaacagacaaagataagataaagaaggagtggaaaaccatcgacgagacttatgaattttgcttcagcctgtacaagggtgatctcgtgctgattcagaagaaagagatgcaggaatctgagtttgcgtactataacggcttcgacatctccagtgccagcatttctcttgaaaagcacgataataaatttgagaacttgaccgagaatcaaaagctgttattcccaaaagctaaggaaggggacgtcgaggtgagaggaatcggcatacagggtctcaaggtatttaaaaagtacatggttacacccctgggggaaatccaggagaccaggactgaggcacgccaaaacattcagcctcgcaaaaagcatggccttcggtga

SEQ ID NO: 2589 - RNA, 3033 nt, synthetic construct
  misc_feature 1..3033: note = Cas9 variant
  source 1..3033: mol_type = other RNA
atgagcgactcctcttacgtgctgggcctcgatcttgggaccaactcaatcggatgggcctgcgtcagactgaataagggtaaacccgacggcttgttagctcagggggttaggattttcgaggcaggactggaaatagatgcctatggccggggtacacctctaaacactgagcgccgaaatgcgcgtcaaagaaggcggctccacgaccgcagaaagaggcggatcctgaaagtgcgccgaatccttcaggaagctgggatgctgccagccaacaagccggatcataaagacgcagagtggaagatgttgctcgccagaaatccctacaggctgcgggctaaggcactggatgaacagattgacctcaaagagattggattatgtatctatcagtttgcccaccgtcgcggcttcctgagtaacagcaagatacttaaaaaggatgacgatagaggcaaattgaaggacgctacgaaggcctttgcggaggatatggaacaaaaaggggcaaggacctggggagagtacctgtcccatctagaccctcacgaacagcggatccgaacaaattatactctccgcgagtggtacacctctgagttcgacctgatttgggaaaagcagcagtcgttttatccacatgtacttacagatgacctgtacaaaagagtgaaggaggccttgttctaccaaaggcccctcaaatcacaggctcacctgttaggtcagtgcgaactggagcctggccggaagcgcgccccatttgcactccttatggctcaggagttcagactgttgcaaagcctaaaccacctgagggtcgtgagttccaccggggatgaacgtctcctgactgacgaggaacggaaacaggcccttgcgctgttgcgatctagaggaaatcagaagtttacaaccctcaggaaggttctgaacttacgcggcacgaaattcaatctggagcggggtggggaaaagactatccaaggaaacaataccgccgcagctctaggcaacctctttggcgaggcctgggatcatttcagctccgaacagaaaaatcagattgtggaggacagactgacaatcggggatactgacgctcttataaggcgcatgaagaaaacctggggattggattcagtcacagccgagatgtttagtgaaaccgagctggaagacggttattgtggcttcagccgaaaggcactcgagaagctgcttcccctgttggaacgggggcacgccctcatggaggctgtgcaggcggcataccctgattatcaaaagaacctgccacgtacggacactttaccgcccctggagaacctaagaaatcctattgtacagaggacactctctgaactgcgccgggttgtgaacgccatcattaaggagtacggaaaatccgacaagatcagaatcgaacttgctagggatatgaaacagaccgccaagaatcgagagaagtcatgggaccgcatgcgggtcagagagaggcagcgtaaagaagcagccaagaaaattttggaggaaactggcaacccagctccccgccggcatgagatagaaaaggtgctgctcgccgaggagtgcaattgggaatgtccttatacaggtaaaagaatctgcatgaacaccctgttaggggatgcaccacaattcgacattgagcacatcataccctttagcaggagtttcgataattctttttccaacaagacgctgtgtgacgtgaattacaaccgaaatgtcaagggcaacaaaaccccgtatgaaagcgcgtcggagacagaacacgaggagatggtttgccgggtgaagcgcttcactggagattacaaagaaattaaacttgacagatttaataccagggagacagattctcgggctgacttcatcgaagagttttccacttcacagttgaacgatacccgatacgccagtagactcgcaggcgaatatctggggaaactatacggaagcgagtggcgcaagcatatccagattgccaaaggtggcacaaccaagtatctgagggacgcttgggatctcaatcgtatcctgtccgacgggggaactaagtctcgggacgatcacagacatcacgccgtagacgcagtggtcgtggctcttacgacacctcagaccgttaaagccttgagcgatgcgaaccaaagggcccccgagcatcgccgatacgctttctcagacatgccactgccttgggaaacttttagacaggatgtggagcaggcaattaacagtataaccgtctcccacaaggtgtgtcggaaagccaatggccagttacacaaggaaacattctatggtctcatcaaagacaggaagaccggggatactcgcacagtactgcgtaagccccttcatgagctgacggacaaagagattaagagagctgaaatcgttgatagctctatccggaaattgattgagcaaaagctcaaagacctggatcagccacccaagaccgcctttaaggacaggaacaatcaccctttcataatcgataaaaacggcaataagcgctttattcataaagtgcgagtctaccaggacgcaaagccagtgaaaatcgcggaaaacagacacgtcaagctaggaggcaatcaccatctggagattttcgaagtgatcgacaagaaagggaacccgacttggaagtgcgaggttatatcactcttcgatacacggcaaagggtgaaagagaagcgccccgtaatcgtcagacaggaccagaatggaaaccctctgaaatttagtcttagcattggtgaagccgtgcagttggattggaatggcgggagggagaccgctgttgtgcaaaagatgtccaaaacaccaaacactgtcgaatatgtgttccggaagcacaatgacgcccgtaaggcagctgatatcccctacaaagagaccattacggtaaagtctgactcggccctgtttgcaagcaacttacagaaaatcgtgataacccctacaggactcattcgccgagccaatgattga

SEQ ID NO: 2590 - RNA, 3033 nt, synthetic construct
  misc_feature 1..3033: note = Cas9 variant
  source 1..3033: mol_type = other RNA
atgaagaacagaaatgtgatcggcattgacgtcgggaccaacagcataggatgggccctggttgaggaaaatgagaacggtctcccccagtcccttaaagctgcaggcgtgaggatcttccaagaagccgtagaggcgaagacacggactcctaaaaatcacaagcgccgacaggctcgtctggccagaagggtgttggcacggcgcgccagaaggaaacagcggttacagaacctgctactcaagcatgggctgcttccaggaggcgtcacggatccggtgcaacgcgaagctgcatttaccacactgggtgacccctaccagttgcgagccaaggggctcaatctgcctctgggactccacgagttcggcagagttttatttcagctgggcgctaggcgggggttcctttctaaccgtaaaactcgctatggacatttgaataagctggatgagctagccgacctcattgaagcggaggatgcagccccaaaaaccggtgacgctgaagagggcatcattagaaaggagatcggggaactgaggcaggccatgtcagcagctggaagtcggacacttggcgagtacctggccggtttggcgaaagaggaacgaaagcgctgcagacacaccgaaagggccatgctcgaggaggaatttgagcggctgtggatggtgcaagcacgcttccatcccgaattaagcgatgagctgaaggtccaggtgcacactgtaatatttttccagagacctctcaaatccaacagggcttctcttgggaagtgttcgctggaaccatcacgtcggaaagccgctcgagcctggcccgaggcacagagatttaggttgctacaagacctgaataacctcgagatcctggatcctcgcacaggagaacttcggagactgagggacaccgagcgcgccattttgctcaatgctctggaacagcagaagagtatgacgtggaacgcggttcggaaaaagttaggcctgcaccaaggcgagaaattcaatctagaaactggggcaaaggccgagaccggactcaagggtctgcagacacttgctagtttgcatgccatcctgcagggctggtttgatgagctcggggacaaacgggatctgcttattgaagacctgatcactatagaggactccgcaggattgtatcgtagactcagggaacactggggcttcgatcgcgagaccgcctttcggctggctacattagagctggaaccaggttacgcctctctaagcctcaaggcaattagaaaactgcttccgcatatgggggcgggccacaggtattccgaggctcgacagcaagtgggatacggctatgaaaccgggcagcgcgacttgcaggagcggctgggagaaccccctgatccaagaaaccccgtcgtggacaaggccctccacgagctgaggcgtgtgatcaacgcattaattcatcgcttcggtcggcctgatgtcgttagagtggagctggccagggaccttaaattggctaagcgagataaggaacggctcgagaaacagaatcgcgaaaaccaaagactgaataggaaggccgaggcagctctagccgaactgggcctcgggcagccatcacgggacgatctgatcaaataccgactttgggaggagagtaagggattgtgcccctacacgggcagagaaatcggtctgagcactttattctctccggaggtagacgtggaacacattataccttattcccgctgtctcgatgactcatacatgaacaaaacactgtgcatgaccgaggaaaataggatgcagaaggggaaccgtactccctgggaggcgtatggcggagacccagcccggtacgagcagatccttcaatgtgctagatattttcctatggcaaagaggaaacgcttcctggaacagggcagcgattttgtcgaccagttcattcagcgacaattgaatgatacaagatacatcgccaagctcgctaaagagtatctggccgcagtgtgcaccaacgttcaggtgacgaaagggggaaccacagcgatgctacggcatcactggggtctgaataggctcctgggcgaagacgatgggcagaaggagcgcggagaccatcgtcaccacgcccttgatgctgccgtcatagcagtgactagcagatctttgtaccaacggctggctaggattgcccatcagcgcggccacgcaccctcccagcgaggtttttacatcgacccaccctggcaggggtatcaagccgatttagctcagaccctcgcgggcatcgtagttagccatgccacaaacagaaagctgactggagcacttcacgaggaaaccgcttacggccacattcctcatgtggggttcgtctatcggaagacactgaataaagactttaagctaggagatatcgaggccatttacgacccatcgctccaggaactggtgaaagcccacttggagcatcacggcaacgatccgaagagggctttcgcagaaggtatacagtgttatcataaagacgggcacacccccatcaagcgcgtcagaattagggccaaacaagtgtctgagaagggaactttttccatctcagaccgggcgggccgtgcttacaagcaccataaaacgggtagtaatcaccatgttgagatcctgcgccaccgagccacaggcaagattgaacctgtgtatttaaccactaaagaggcaaccgaaagagccaggcgagggggagagccagtaatacagcgcgatcatggccccgaatgggagttcatcattagcctctgcatcaacgacatggtcagactgggggagggaggccaggtggcttactttagggttcagaagattgaagcaacaaataaccgggtgacccttcgatcccacctggccgcgactttggatgacgaggatatgaaagtcacaacgtctgtgcctaagctcgctgtaatgccaggtttccaaaaggtgctggttaccgccgtcggggaagtgctagagctgcacgactga

SEQ ID NO: 2591 - RNA, 3033 nt, synthetic construct
  misc_feature 1..3033: note = Cas9 variant
  source 1..3033: mol_type = other RNA
atgaagagaatggccgctgtgggcctgatgcccgcagaccctaccgaggccaaagcgctcgaacttctggatccatacgctttgagggccgcagggttagaccaggccctgccgctaacacacttcggacgggctctctttcatctgaaccaacgccgaggtttcaagagcaatcgtaaaactgataagggcgacaacgagtccgggaaaatcaaggatgcaacgaagagacttgacgaagagatggccattaaaaatgctaggacctatggagaatttctgcacatgcggcgcacatctgccactgatcccaagaacgtccctaccgttagaacaaggttgtcaatagcgcggcgcgacaatgcagagaaagaggaagccggctacgatttctatccagaccgaagacatctcgctgaggaatttgataagctgtggaaagcccaggcaggttacagtcccgacgtgctgaccgatgagctcagggacgagatcagcgtaattatcttccaccagcggcctttaaagactccagaagtggggctgtgcttgttttccggatctcatggcgtccccaagaaagacaagcgtattccttcggctcacccacttaaccagcgcagaatcctgttcgagacaataaataacctaagggtggccgcgcggggcgaaccggcccgagggctcacccgcgatgagagagacgcaatcgttcacgctctggataataaagcccatacgaagtcacttagcggaatgagtatgaaactgaaggctttgggtaaagtgattaagctcaggcccgaacaatcctttactctgcagaccgccaaccgggagacaatcgcatgtgaccctgtccgcgcctctttaagccacccagatagattcggccccaggtggtccatgctggacgctgatgcgcagtgggacgtggtacagcgtattcgggcagttcaatcagaggccgaacatgatgctctcgtgaagtggcttatggccactcacgggctggaccgagatcacgcagagagtaccgccaaagctcctttgccagaaggatatggcagactaggtctgacagccaccaagaggatcctcgcagcgctggaggctgacgtcataccctacagcgacgccgtgaaagcatgcgggtggcatcactctgatggacgcacgggcgaagtgcttactgagctgccgtattacggccagattttggaccggcatgtcatccctgggacatacaatgagtccgatgacgatgttaccagatatggaaggattactaaccccacagtgcacatcggtctcaatcagctgcgccgattagtaaacaagatcattaccgtgtacggcaaaccagacgaaatagtcgtggagctggcccgggatctaaagctctcagaagaccagaagcgtgatgttcaaagagacatcaaaaagaatacggatgctgccattgcacgcggggctaaactgagcgagatgggagtgcctgacaccggcgccaacaggatggtccttcggttgtgggaaagtctgggtgatgacgtgatgacaagaaactgtccctattctgggaagaggatctccgcgactatgctctttgacggcagctgcgatgtagaccatatactgccatactcgcgaacccttgatgacggattcgccaatcgcacactgtgtttgaaagagtttaaccggcagaagactgataagaccccctgggaggcttggggcgacacccctgcatgggccacaattgaagctaatctcaaaaacctgccagccaataaggcatggagattcgcgccggatgccatggagaggttcgaaggggagaacgactttacttctcgtgctttaaaagatgcccagtatctgtcccgcatcgcacggacgtacctagacgctctctatgatggagccgacggtaagtcacacgtttgggtggtccccggcagactgacagagatgcttaggcgacactgggggttgaatagtctgctccctgataaagacggagcagtgaaggccaagaaccggaccgaccatcgccaccatgctatcgatgcggccgtcgtggcagctactgacagaagcctgattcaaaggatctccaaaatggcccggaaggatgaagttaatggcgccgaggaagtggctcgatctgtaccacccccttgggagggtttcagaaccgacattgaaacacagttagatcgcataatcattagccacagggcagaccacgggcgtatcgatccagccgcgcggaaagacggccatgattcaaccagtggacagctgcacaacgacactgcttacggccttggggagggaaattccgtcgtgagcagaaagcccttgctctctctgaaatcaaacgatatcgaggttacaacgaagggtgccaatattagggacgtggacctacagcgccatctggaacgaataaccagaggcctcgatgggaaagcactggaggccgctcttgcagaatttgccgcgactgctaagttgccggacggaacagataacccttactatggcctgcggagggtccgcttagaggaaaccctccaacagggtgcccgtgtggaggtaaaggacagaaatgggaaaccattcaaggcatacaaaggcgatagtaaccactgctatgagatctggcggatgcccgacggaaaggtggttcctcaggtcattacaacttacgaagcccatcagatcgatgtggagaaaaagccccacccagctgccaagaggctgcttcgcatttttaaacgagacatggtggcaatcgaacaagatgacaaggctataatcggctatgtccagagcatgcacgttgccaacgggctgttcattgcgcctcataccgaggccaatgcagatgctagatcccgggacaaatctgattcgtttaggttgatccagatgagcgccggacccctcgtgaaggctaacgcacgcagagtgtacgtagacgaaatgggcaggctgcgggacccaggtgccccgtcctga

SEQ ID NO: 2592 - RNA, 3039 nt, synthetic construct
  misc_feature 1..3039: note = Cas9 variant
  source 1..3039: mol_type = other RNA
atggccaacatgagatacaggctggctctcgaccttggcagcacctccctggggtgggcaatggtgcggttggatgcccagaatgagacatgcgcggtcatcaaggctggagttcgcattttctctgacggtcgaaaccccaaagatggctcaagtttagccgtgagccgtagagaagcaagggccatgcggcgcagaagggaccggctgctaaagcgcaaaactcgaatgatggctacgctcatgaagcacgggtttttccctcaagatgaggcagccagacaggctctggtaaataaagaaccatttgcccttagggcgaagggactggaccatgcattgctcccggaggagttcgcccgggctctgtttcacataaaccagcgtcgcggcttcaagtccaatagaaaaaccgataagaaagagacagactcttcggccctgaagaaagcaatcggtcagctcagggaggctatgcaagcctcagggtgtcggactgtgggagaatggttatgcgcgcgacatcagcagggcctgagcgtccgcgccagatatagggagaaccggattaccaaggatgacggcaagacaaaaatcgaaaagagttacgatctttatattgaccgcgcaatgatcgaggctgagtttgatgccttgtgggctaaacagtccgaactgaatcccgagctattccacgaaaccgccagagcagagctcaaggactgtctgcttcatcaaaggcctctgaaaccagtgaagcccgggcgttgcactttgctccctgacgaagaacgggccccactggctttaccctctcagcagcgatttagaatataccaggaggttaacaatctgaggctccttcgcgaaggactgaacgaggaacctttgacactaacccaacgggatcagctgatccaggcgctcgagacgaatccaaaaagatcattcactcaaattcagaagctgcttggtttttccggccagttcaacctgcaggacgataagaggaccgaattgaaagggaatagcacaagtgcaatgctcagcaagaaagagtttttcggatctcaatggctgtccttcgacgagactcaccaggatgaaatcgtgatgcagttagtctcagaggaaaacgaggcccgcctgattgcttggctacaggccgaaaccggcgtggacgagatcacagcagagcgaatagccaataccccgctcgctgaaggttatgggagcctgagtgccaaggcacttgagaaaattttgcccgcgctgcgggctgatgtaatcacgtacgacaaggccgttctcgcagccggatttgatcaccattctcacatttcccatgctgccactggcgaaatcctgcctgaccttccatattacggccaatacctgcagcgtcacgtggggttcggaacaggtaagcccgaggatcctgcagagaaaagatatggcaagatcgctaacccaaccgtccacattgggttgaaccaggtgaggactgtggtcaatgccctcataaaacgctacggacatcccagcgaagttgtggtagagctggcgcgggacttaaagcagtcgcaagaacagagaaaagaggaacaggcccagcaagctaagaaccagaggcgaaatgagcgcatgcggcaggacatcgcaggcctgctaaacacatctaccgagagagtgagggccctcgatctgcaaaagatgattctttgggaagagttgtcctttaatgtcgctgaccgtcgctgtccgtattcaggtgtgcagatcagtgcccagatgctgttcagcgatcaggttgaaatagagcacattctccctttttcccaaacgctggacgattctttaaacaataaaaccgtggcaatgcggcaggcgaacagaatcaaggggaataggacacccgccgaagctgccgcagacttcgctgcccagggctggccagtcgaggatatgctgcatcgagcaagccttatgcctaaaggaaagcggtaccgctttgcccaggacggcatggctcaatggttgagagaggataaagggttcctcgcgagggccctgaacgacactcggcacctatcacgagtggcaagagaatatctgagtctcgtatgcccccagggaacccgcgttatcccaggtaggatgacagctatgctgcgtgccaagtttggccttaatgatattttggggctgaacggagagaagaatcggaacgaccatagacaccacgccgtggatgcttgtgtcatcgcagtgactgaccagtccatgttacagaaattcgccaaggcgagcgcttctgccagggaaaaacaactcaataagctggtcgagtcaatgccccttccttgggacagttaccgcgatcatgtgcagcgagcagttgaaagaatttgggtgagccacaaaccagaccatggccacgagggtgccatgcacaacgataccgcttatgggctgttgggcggaggccatgtacaggtccggaagaggatggacggggtgcgcacacgtgagaccgcagccctcaaagttatagaatttgcggatagacaagctcacccgcggcatggactgctacccaacggtgagcctatgccatacaagggctacaagggggactccaattattgcatggaaatcgtgaggaacgataaaggaaagtgggagggcgaggtcgtgtctactttcgaagcctaccagctggtacgccagcacggtctcgcacgactgagacatcccgccctttcggtgagcgggcggcctttggttatgaggctgttacgcaatgacacgctcagagtcattcacaacggcgagcagaggacagtgcggatctgtaaaatgaccgctgaaggagtgatcgccctggcagatactaccgagtccaatgtcgacgctcgtacacgcaccaaggatctttcatatatttttaaaactgccggcagtctgcaaaagtctaaggggcgaagagttgcgataagcccatccggagaaatgaaagaccccggcttcttcgattga

SEQ ID NO: 2593 - RNA, 3051 nt, synthetic construct
  misc_feature 1..3051: note = Cas9 variant
  source 1..3051: mol_type = other RNA
atggaggtgttcgtcgacgttagcgccagacagctgggcatcgatctcgggattggaacctgcggttgggcacttctggctgaagactccttgatagccttaggcacaaggacttttgatgtgcccgagacggacaaggaacggatccctaccaaccaaattcgccgacaggcgcgtgggatgagaagggtaatcgatcggcgcagacagaggatgaatgctgtgcggcgcctgctagccgaccacggactcctggcagatggcggtaaacttgggctggccacagtccgattggacccatggcaggctagagcagagggactcgataggctgctgtctgccggcgaactcgctgtggccttaggccatattgcgaagcaccgggggttccgttcaaacagtaaacgcgacagaggagcaaatgccccgaaggagagctccgctatgctgggtgccatcgcacaaactggcgagaggcttcagcattggcggaccgttggggaaatgttttggaaagatgagttctaccagacacgacgcagaaacagggacggagattattctcggaccgtgcagcgcttggacctggaaactgaggtccacagactactcgctgcccaaaggcgtctgggcaatccccttgcgacatttgacctggagcagtcgttcatagatgtggcctttttccagcggcctttggcagactcagatgacaaggtaggtccatgtccctttgaacctagcgagaagcgagctgccagacatagtccatccttcgaaaggtttcgcctcctgtctcggttagctgccctgagactcagctccggggcaggagagaggcccctttcagatgccgagttcgctgcggcatgcgccgactttggccgcctgcagggcttcagtttcaaacgattgcggcaacacctaaagctggatcctagcatccgttttgctgggattgccccagacgaggagggaaaaagagatgttgtggcaaggtctggtgaagccaccccgggctccgctgccctccgccactgtctgggggacacggtctgggataacatgcttggaactcggcccgcactgttggacgcgatcgctgccattctcaccttcagagacgatgcagacaggatcgccgagggcctggctggtttagggatagaggaacctattctggatgccctaatggacggcgtgcgaaatggatcatttggcaagttcaaagggccaggacatatcagcgcaaaggcttgccgcgccctcctgccccaccttgcgcggggtagagtgtacagtgatgcctgtgctgacgcaggctatgatcattctaggcagacagaaactaacttggacgatattcgtaatcctgtcgcccgcaaggctctgggggaggccctcaaacagatcaagatcattatacacacccacggacggccaacagcaatccatgttgagatggcgagagacattggcaaatccgccgatgaaagggacgagatcaagaaaggtatagataagcgaaacagcgaaaaagaccgggctcgccaacagtttcacgagatggtggggacccccgccgcaggcgctgaagacctgcttagattcgagctgtggaaggagcagaatggatggtgcttgtacacgggcagggaaattccgatcgatgccctcgtatcgtctgacaaccggatccaggtggatcatattctgccttggtcccgatcaggggacgatagttatatcaataagactttatgttttacagaggcaaaccaacacaaaaagggaatgaccccctgggaatggctgcatgacgatccagagagatgggagaaattcgcccgcactgtcgaaggttgcaagacaatgaaaggcaggaagaagcgtaatctactcctgcgggacagctccagacttgagaaagaatttaggtctcgcaacttgaacgatacccgatacgcttgtagactgctcctggggattttaaagcacacgtatcctgacatagtggttgcggcccggcccggaccactgaccgataggcttcgccgtgcatggggcttgcagagcctcaaaaagcacgaggacggtacaagaaaagatgacgaccggcatcacgctctggatgccgccgtggtcgctgcaacttcacagagtatgctacagaggctgaccacactcttccaaaaggccgaacgcgaagggggccgaagagactttgtgggactggagcccccttggccaggcttccgggcggatcttgaagctaagttggagggggtagttgtgtccagggccgaacgcagaagggcacggggagccggccataaagacactatccgtgctattggtgagggggatgcaggaccggtcgtgtacgaacgcaagcccgtcgccgcgctgaccgagaaagacttagatcgagtgaaggaccctgagagaaataaagttctcatcgaaaacctgaggcagtggatcgctgccggcaagccaaaggatcccgacaaagcacctcggagcccaaagggtgatcccatgacaaaagtgaaacttgtaaccactgacgacgtccgcattctggtgagaggcgggacggccgataggggagacatggctcgggttgatgtgtttcgacaggccgacccgaagggcagatggcgcttcttcttggtccctgtgtacccacaccaggtatttgatcccacagactggcctcaacccccaaatagggcagtggttgcttataagcctgagaaagaatggaccgtcatggggcccgatcacgagttcctctggtctctgtacccattttcatggatagccgtggaaaaggcggacggaactcggatcgagggctatttccgtggtatgcatagaagtaccggggccattagcatctccccgcaccattctaagtcgctagcaagcacaggaattggcgctaaaaccctggcctcctttaggaagttcgctatggatcgcatgggtaacctctcagagatcgaacgggaggtgcgaacttggcacggcgtcgcatgcacatga

SEQ ID NO: 2594 - RNA, 3054 nt, synthetic construct
  misc_feature 1..3054: note = Cas9 variant
  source 1..3054: mol_type = other RNA
atgagagtggacagcctggggaggtgcctctccgatgaggaatgggcccgggtcatctaccacctttgtaagcatcgcggcttccactggatttctcgagctgaggcaaaacagaccgaaggagactcaaagagtgagggtggcaaagttaagcaagggctggccggaacagcgaaattgatggatgaaaagggctatcgtagcgctgccgagatggtgttagcagagtttcccgaagcccagagaaacaagcagggtgagtacaggaaagctctgtcccgggaactactcgcaaaggagctggcccttctgttcgctcgccagagagtatttgggaataggcatgccactgacacgttggagaccgcgatactcggaaactctgataaaaagtcgggcctgttctggcaacagaaacctgcactggccggcgctgacctcttaaagatgctggggacatgcacttttgaaaagaatgagtatcgggccccaaaagcatcattcaccgctgaacgccacgtgtggcttacacgattgaacaatctgagaatcgtcaccgatggaattactaggcagctaacagagcaggaacggcaactcgtgctgccgcttccctaccgtcaggccggtgacctgacctataagcagttgggcatggcgctcacgaaagccgggctgttagaggcaggatgttttaagttcatcggcctggcttaccctactgaggcccagaaagctgaaggtaagaccaaagatccagagagcgccacactcgttaagattcccgcatggcaagaacttcgccagactctgaacaaggccagtttgaatgacgagtgggaaaaactatccggggatgctctgtgcggacagcctgagatctttgacaagatagcgtggatcctctctgtgtataaagatgacgacgaggtcagaaccgaactggcaaaacttgtgctgccaaaccccgagggcttgacagaagccctcctgaatattaggttcgataagtttcatgctttaagcctgaaggccctacgggcaatcgtacctcacatggagaagggcctccgatacgacgaagcctgtgttcaagctgggtaccaccattcccagctgcacaaaattggagagggtgagcataagtatcttccaccgttgtacgatggccgcgacggggatggaagaatgatcttcgccgaagacgcagatatacccaggaaccctgtggtcctgcggtcactcaatcaggcgcgcaaagtggtgaacgctattatcagaaggtatggcagtccaagcgccgtccacattgagatggcacgtgacctgtctcggccctttgatgaacgaaataagatcaaaaaggaccaggatgagtaccaagccagaaaccagagggaccgcgagcagttcatcgaacttttcggtcaccctccaaaggggctggagtttgaaaaatggcggttgtatagagagcagaatggccaatgcgcttactcccagaagcccctcgcctcaagcggagacgttgcagaaattttcctggatggcagtaccgagatagaccatgctttaccgtattctaggtcctttgatgacagcaaaaacaacaaggtgctggtactaacgcgcgagaatcgagataaagggaaccggactccttacgaatacctcggaggtgccgagaatagtgaacgttggcagagattcttttctttcgtggagtccaacaaggcgtataggctggccaagcgcacacggcttttgagaaaagactttggcgctaaggaatcagaggagttcagggaacgaaatctgaacgatacccgctacgtctgtcggtttttcaaaaattatgtggagcagcacctcaagctggcagaagggagtgaggccaaaagatgcgttgtggtcagcggacaattaactaactttctgaggacacgttggggccttttgaagatccgctccgactctgatcggcatcacgctctcgacgccgcagtggtagcggcctgtagccattcaatggttcagagactgagtaattactccaggacccgagaactagaacaggtgcgggatggtttcgtcaacattgagacgggggagatcgtgaatcccgctatgcaccagcaactgcgcgagcactttccagacccttggccctatttcagacatgaactcgaggccaggctgaaaatagatagcccagcacttttgcgggaggaaatggctcgactgtcttcatacaccgaggaagagttagccgcactcaagcccctgttcgtcagtagagcccctcagcgcaggaacggcggagctgcgcacaaggacacaatttatggccagccagaaaaacttaagaaaaatgggagcgtgtcccaaaaggttgccctggcatctttggctctcaaagacatcgatctgctagccgacccgcatcgtaacgccaagctgtacggagctatccgggagagactcgaggcacacggtggcaagggggataaagcctttcccgcgactaatcctctgaggaagccagacaaagaaggaaaccccaccggccctattgtgcgcacagtaactaaggtcatcgataaactttcgggtattccagtgcgagggggcatagctaagaacgacaccatgttgagagttgatgtgttcacaaaggccggacggtttcacctggtccccgtgtacgtacatcacagggtgaccggcttaccgaatcaggcaatcactcgcgggaaagacgagaaccagtgggccattatcgatgacacgttcgaatggcgttttagcctctatcctaatgatctggttcagatcagacttaaggacgagacacatctgggatactatgcttccaccgatcggtcaacttcgtctattagcatatgggcacacgacaggaaccaatccgtcggcaaagacggtctaatccgctcaattggggtgaccacagccaaggatatcgaaaaattccatgtggacaccctcggaaatgtctacccagcgccccctgagaagcgaagaggcctggcttga

SEQ ID NO: 2595 - RNA, 3066 nt, synthetic construct
  misc_feature 1..3066: note = Cas9 variant
  source 1..3066: mol_type = other RNA
atgagaaggcggcgcgaccgattcaagcagcgtcaagccgctctgctcaaacaccttgcaggcgtggggctgtttcccgccgatgaggcggctagaagggaattggccggattagacccttacgagctgcgggcacgcgccctacatgaagctctcccactgaaccacatcggtagagcacttttccatctgaatcagaggcggggctttaagagcaaccgcaaaaccgatcgagggaaggccgacgatgagggaaaaattagattgggcgtcgctaggctccaggaagccatgcacgagaagggttccgcgacactgggggagttcctgcatggacggcgtgcagccgctactgacccgaatcagataccctctgttcgcacgagactcagggccgaatcaggcgagggcgcacgaggggatggatatgacttttaccctgatcggcgcatgttagaagacgagttcgaggctatctgggaaagtcaacaggtgcaccacccagccgtactgaccgatgagattaagcagagatttttcgaagtgatcttttatcagaggccccttaaacaacctgagattggtacatgcactttggtcgcgggcgaacggcgcctgccaaaggcccatcccctattccagaaaagaaggctcctggaggagcttaacgcactgcgtatcgtgtggcctggggttcaggctgaattgctcagccgggagcagcgagacctggcctacttaaagctgaaagataagagagctgtgaggtttgaatccctccgcaaggcccttaaactggacccagacgcacggttcaataaggagtctgaaaacagatcggagttgaaaggagatgaggtcgccgctgaactaggcgcgaagtcaaggtttggtgggcgctggggacacaccgcaccggccgaccaatgggagatagtgagccgaatccaggctctggaaagtgatgacgatgaggcccagttctgtgtatggctctccgaacggtatggcctggactctgagcaagcacgtgccgttgctgccgcaagacttccccagggcttcgggaggtttggactgacagcgaccactcgcttgattaaagctctccaggatgaggtgatcgtctacagcgaagccgtgcagaagacaggtctgggccatcactccgacttccggaatggggaggtgttagcagaactgccttattacggaattgccctagagagacacatcatgccaggcaccggtgatcccggggactcagatgagatgagggtcggccgagttacgaaccctactgtgcatataggactcaatcaactgcgccgggtagtgaacagacttattaaaaggtacggcccaccccgtcagatcgctgtcgaattggcccgcgagctgaagctcgacgaccagcacaagcgggaaattaatgggagaaacaggcagaatcgagaggcagctgaacggcgcagtcaaaaactggtggatatcggaatcgccgacaagggtgcgaacagagcccttctgaaattgtgggaggagctcaatccggataacgctctggacaggcggtgcgtttataccggccgacagattagcatagaaatgttattttctggggcagtggaggtcgatcatatcctgcctttcgccgctacactagacgattccaacgccaataagctcctgtgtcttagagaagcaaaccgcaataaaaggcgtcggtcaccctttgaggcgttcggacagggcgccgactgggaagagattgctgccagagcagctaggttgccacgcgagaagcgatggagatttgaacctgatgccatggcacggttcgacactgaggaaaagtttctggccaggcagctcgtggatacccaatacctgagccgcttagctcgtgagtatctgggtgtacttttccccgacaaaggggaaggcagtggaagagtttgggtgtctccaggccggttgacagagatgctcaggcgctcctgggggctgaaccacctactgcccgatcataatctcggaggtggcgcggaccagcctaagaaccgaagagaccaccggcaccatgccatcgatgcaatagtcgtggctgtcaccgacaggcatctgcttcaggccattgcccgcgaggctgggcagagaggacacgaagcagccaataggatgacggcggatttgccagtgccgtggcccgactttgatcgggacgttggccaagtgatccgtcaggtagtcgtgagccaccgcgctgatcacggtactgtttcgaaagccggggcagccaagggccaggactctacagctggacgactgcataacgataccgcatacggcttaactgggcaaacagacgagaaaggaaataccatcgtggtcagaagggtgcctctcacggccctgaagaagccaacctccattgaagcggtacgggatgacgagcttcgcaaagctctgtcagtgtggacaagaggctatgatggtaaggccttcgaggcaaggttgagtcggtttcccgaactcgggcctctgcagttccgaggaatcagacgcgttagggtcgtggagccactaactgtgattcccatacgggacagctccggccgtgtctacaaaggttataagggcgactctaactacagatacgatgtttgggaactgaaagacgggaagtgggtggccgaggtggtaagcatgttcgatgctcaccagtcaagttggacctccccggtcaggcgcgaaaatcctacagcccggaaggtgctcagcctgcagcaaaacgacatcgttgcaattgagccagagggaaaagaacgagagcttatgagagtggctcagttgaggcagggcgggcagatcactctggccgcgtgccatgaagccggagatttaaagcgccgggacgcagagtctaatgaagtcgatccctttaaatatttctcacctaccgctggcggtctcaagagagtgcgtgccaggcaagttcgggtggacgagctggggcgcgtacttgatcccggaagtcgagacagagagaggggcgctgcatga

SEQ ID NO: 2596 - RNA, 3066 nt, synthetic construct
  misc_feature 1..3066: note = Cas9 variant
  source 1..3066: mol_type = other RNA
atgaagtacaccctgggcctcgacgtggggatcgccagcgtcggatgggctgttattgataaagacaacaataagataatcgatcttggtgtgagatgcttcgacaaagcagaggaatccaagacaggcgagtctctggccactgcgaggcggattgctcgcgggatgcgacgtagaatctcaaggcggagtcagcgcttgagattagtgaaaaagctgtttgtacaatatgaaattatcaaggatagctccgagttcaacaggatatttgacacgtctcgggatggatggaaagacccctgggaactacgctacaatgccctctcgcgaatcctgaagccttatgagcttgtccaggtgctgacccacattacaaaaagaaggggcttcaagtcaaaccggaaagaggatttgagcactaccaaggaaggtgttgtgatcacaagtattaagaataactccgagatgctccgtaccaaaaattaccgcactatcggggaaatgatatttatggagacaccagagaactctaataagagaaacaaagtcgacgaatatattcataccatcgcaagggaggatctgctgaatgaaattaagtacatcttcagcatccagcggaaactcggatccccgtttgtgacggagaagttagaacacgacttcctgaacatttgggagtttcagcgacccttcgcctcaggcgatagtatacttagcaaagtaggcaagtgtactttgctgaaggaggaactacgcgctcctacctcttgctatacatccgagtactttgggctcctgcaatcaatcaataaccttgttctggtggaagacaataacactttgaccctcaacaatgaccagagagcaaaaattatcgagtacgcccatttcaagaacgaaataaaatatagcgagattaggaagctgttagatatcgagccagaaatcctgtttaaagctcacaatctcacacataagaaccccagtggaaataacgagtctaagaaattctacgaaatgaagtcctatcacaaacttaagagcaccctgcctacggacatttggggtaaattgcactcgaataaggagtctctagataacctgttctactgtctcactgtctataagaatgacaacgaaatcaaagattacctgcaggccaataaccttgactatctgattgagtacatagcgaagttgccaacatttaataaattcaagcatctctccctggtggcaatgaaacggatcattccctttatggagaagggctacaagtattcagatgcctgcaacatggctgaattagacttcaccgggagtagcaaactggagaagtgtaataaactaactgtggaacctatcatcgagaacgtcacaaacccagttgtgattcgcgccctcacccaggcaagaaaggtaataaatgctatcattcaaaaatacggactgccgtatatggtgaacatcgagcttgccagggaagcgggcatgacgcgtcaggatcgggacaatttgaagaaagagcacgaaaacaatcgaaaggccagagagaagatttccgatctgatcaggcagaacggtcgcgtcgcatctgggctcgacatactgaaatggcggctttgggaagaccagggaggcagatgcgcttacagcggcaagcccatccctgtgtgtgatctgttgaatgactcactcacccaaattgatcatatctatccatacagtaggtccatggacgatagctatatgaacaaagttctggtgttaacagacgagaatcagaacaagcgctcttacactccctacgaggtctgggggtcaaccgaaaaatgggaggattttgaagcccgaatttatagtatgcatctgcctcagagcaaggagaagcggctactcaatcgtaacttcatcacaaaagacctggattcctttatatctagaaatcttaacgacactaggtacatttcgcgcttcttgaagaattatatcgaaagctacctgcaattttccaacgattcaccaaaaagttgcgtggtatgtgttaacggacagtgcaccgctcagctccggtctagatggggtctgaataagaacagggaggagagcgacttacaccacgccctggatgcagccgtgattgcttgtgcggaccgaaaaatcataaaggaaatcacaaattattacaacgagcgcgaaaatcacaactataaggtcaaatacccccttccgtggcattccttccggcaggacttgatggagaccctcgcaggcgtgtttatttcaagagcccctaggcgtaagatcactgggcccgctcacgatgaaacgattcgcagcccaaaacatttcaataagggactgacatctgtcaaaatccctctaaccactgtgaccctggagaagctcgagacaatggttaagaacaccaaaggcggtatatccgacaaggccgtgtacaatgtactgaaaaaccggcttattgaacacaataacaagcccttgaaagcatttgccgagaagatctataaaccactgaagaatgggactaacggcgctatcattagaagtatcagggtcgaaacacccagctacacgggagtgttccgaaatgagggcaaggggatttctgataactccttaatggttcgggtggacgtcttcaaaaagaaagataagtattacctcgtgcctatatatgtagcccacatgatcaaaaaggagctgccatcaaaggcaattgtgccgcttaaacccgaaagtcaatgggagctgatcgacagcacccatgaatttttgttctcgctctaccagaacgattatctggttattaagactaaaaagggaatcacagagggttactaccgctcctgccacagaggcaccgggtctctaagcctgatgcctcattttgcgaataacaaaaatgtcaagatagacatcggagtgaggacagctatttcaatcgaaaagtataacgtggatattctcggcaataaaagtatcgtcaagggtgagccacggcgagggatggagaaatacaactccttcaagtctaattga

SEQ ID NO: 2597 - RNA, 3072 nt, synthetic construct
  misc_feature 1..3072: note = Cas9 variant
  source 1..3072: mol_type = other RNA
atgaagatcctgggcttcgacattggggtggccagcataggatgggcttttgtcgagggtgatgaaatcagagactgcggcgttagaattttcaccaaagcagagaaccccaagacaggggaatccctcgcccttcctcggcgcgaggcgcgaggagtgcgtagaaggctggctcggcgcagagtaaggttgaatactatcaaaaagattatctgtaaagaatttgatttacggctgtctgactacatagccgatgacggcgagctaccaaaggcatatcagacgaacaaggataccaaatcaccgtacgagctccgctataaggccctgaatgaacgacttagtaaagaggaactggctagagtgatcttgcacattgcaaagcataggggttacgggaacaaacacgccaaggacggagatgacaaggatagcggcaaagtcaagaaagctatcggcgagaataagacactcctggagcaaaaagggtatgaatccgtgggagagtactgcttccgggaatttttcaagtctattaaagacaaggatggtgagactcataacatcccctcgcagaatatacgtaacaagaaaggcaattatgaccgctgtgtttcacagaagcagctggaagacgagctcaaattaatttttgccaagcaaagaaaactggggttcaacaaggagtttgaagatgcgatccttgaggtggcattctaccagaggcctttgaaggactttgatgacaaaattggagattgcatcttctttgacaatgaaaagcgggccccaaaagagagcatcagtgctattgaatttgtcgccctgacccgaataatcaacacactaaagtacctctccaaaaccactggcgaggtgtatgagaaggaaattatcaataagatatggcagaaaattctggagaacggtaagatgacatacgcagaacttcgcaaaatcctggctttggattctagcgtattctttaaggacaaagatctcgactataccctggggatcaaggaggccgaaaagattaaattcatcgagtttaagaaattaattaagttcaaaaaggcgctgggatcctttgatggcctctcaagagagatacttgacaatatcgccatgcagattgcaatcacgaaagacaggcaacggctgttggaaaagctagaggttttccccctgaacaaggaacagaaagagaacctcagtcagctgaattttagcaagtacatcgatctttctctgaaggctttgaaccagattctccctttcatgcgcgagggcagaaggtatgacgaagccaaggatgacgctaaactgcaagagaaggccaagaatactaaaaaggaagagtttttaccacccctgaaagagttcgatctaaacctcaccaatcctgtggtcgcacgtgccctggctgaatttcggaaggtgcttaacgcgttgctgaaaaagtacgggaaggtgcacaaaatacatctcgagttcgcacgagacatgagactggattttgacgaaagggagcgccttatctccattcagaatgataacttcaataagcggcagctggccgaagacttctgtaaagagcacggattggaaccatcaaacgctaatatcctcaagattaaactgtggcaagagcagcagtggcactgcatgtatagcggtgagttaatcggcataccggatctgaaggaccccacaaagctacaggtcgatcatatctacccttacagtagatcttttgacgactcctatactaacaaagttctcgtgagggccgaatggaatcaagagaaggggaaccacaccccattcgaagcatttggaggcgataaaaataagtgggacaaaattgtagccctggctgagaaacttccccctagcaaaaagttgaaccgctcggaaaagtctaaaaaggataaactgctcgacgagaagttcaacgataaagagctgggtttcttagcccgaaatatcgtggacacagggtacattgcacggctggtcgcgaagtatatcgatatgtaccttgagttcttgccactcgaagaaaacgagaatacctccctggctcgtggcgagaagggaagtaaaaagcatataggcattgtgaacgggagactaacgtcagaagttaggcacaattggggactggaccccaaagatcgcgacaaccacctccatcacgccatcgatgcaattgtgatcgcctatatgaatgacaagcggataaaggcttttgccgatttcagaaggctgaaagagcttaagatcaaacgatacggtcgcgaaattactgaggacgaatatcaggagaagaaaaaggagttgagctgtgcaccgtttgacgatttccggaacagaacactggaaaatatcgacaaaatttttgtctccaggcctccccgtaagcgcgctcggggcaccttacatgaggaaactttctactctatcgatgacaagaaactcctgaaggcctacgggggaaaagagggcatgcagagagcgcttagcctgggtaagataaggcagattgggacaaaaatcgtgaagaacggcaccatggtacgagttgatatctttaaggacaaacggggacgcttctatggcgtgccaatttacacgatggatttcgccttgggggtcctccctaataaggctgcagtgtcaggaaaagacaagaacggtctgatcaaagaatgggccgagatggatagtggctatgagttttgcttctccctatttaaggacgatctgattctcgtccaaagaaaagaaatgcaggagcccgaactgtgttacttcgtgagctttgactcttcaaatgctcagatagacgttaggagtcacaacaatcatttcagcgtgcttaacgagaaccagaagttgctgtttaagtccgccacccaagcagaagtaatcggggagtctattggaatccagaatttaaaagtcttcgagaagtggcacgtgtcgccactcggcgaagttcggaaagcggagtttagcccccgaggtgaagccaagctgaaaacatccaagaagaggaaaaagtga

SEQ ID NO: 2598 - RNA, 3072 nt, synthetic construct
  misc_feature 1..3072: note = Cas9 variant
  source 1..3072: mol_type = other RNA
atgaagatctacagcttcgacattggcgtggcctccatagggtgggcttttatcgagaacgaagtcctgcaggattgcggaattagaatcttcaccaaagcagagaatcccaagaacggtgcctctctcgcgcttcctaggcgggaagctcgcggcgttcgaaaacgtctggccagaaggcgggggcgcttgaatacaattaagcaattactgtgtaaagagtttggactacagctcgaagactatctgtcaaacgatggcgagcttccaaaggcatacactgccagtaaggctaatccgctgaaaagcccctatgagttgagaacgctcgcactgtcccagaagctggactctaaagatctcgtgagggtaatcttacacatagccaagcatcggggttacgggaacaaacacgctaaggactcgaaggataccgaatcaggaaaagtgaagaaagccatcgagttcaatcgcaagacactggcggaaaaaggctatcgaagcgtcggcgagtacctttatagagagtttttccagcaaagtaggatttcccagaacaatggggcaactgaatttatcaacgtgcggaataaggccggaaactacgagcattgcgttgctcaggacatgttgaaagaagaactggaatctattctaaatgcccagcgtcaattcggttttagcctcaagcaggatttcgagtccaagctgcttaccaaaatctttgagcagcgccctctgaagtcattcgcagacaaagtgggcaactgttgctttatagctggggaaaagagagccccaaaagatagtcccagcgcgattgagttcatcgccttgtctaggacaattaataccctcatcaacctgtccaaggaatcaggagagatctacaaccgggcaattatattacagatcgtcgaaagcactctgaagaaaggcgagattagttataaggagctccgagaaatcatacgccttgacgagagactgaggttcaaagatcctcggttggactactctcgcgaaattaaggaggctgaaaaagtgaagtttctagagttcaagcaactgaaaggttttaagaaagccctcggggagtccttcacaaccctggctatcagccagcttgacgaaatcgccgagcacattgcactgatcaaggatagagtaaaattgaatgaaaagctcgagtcgtatgccctgacgaaggagcagagggaggctttatctaacctgtccttttcagcgcatattaatctaagtctccaagcactgaaacagatacttccattcatgcgtggagacaacggcgagcagtgtttggattacgacgaaagcgttgagaaggccggcctgaaagctctctccaaggatactctgaaagggcagatgcttccccctctgaatgaatttgagccatatttgtctaacccggtggtcgcccgggcactcgccgagtaccgaaaggtgctgaatgtgttactgaaacaatatggaagcccccacaagatccacattgaatacgctagagaggccaagctatcaagtaccgaaaggcagaaatacgagaaggaacagaaagacaactatgcagcgaatcaggctgcccataagaaatgccaagagctcggtctggagccttccagcacaaaccttttgaagctgaagctctggcaggaacagggcgggctgtgtttatactctggagcaaaaatcactatctcatatctgcaggatccaaccgcccttcaagtcgaccacatttacccctatagtcgcagcttcgatgactcctacatgaataagtgcttggttctcacaaaagctaaccaggagaagggcaatcggaccccttttgaagccttcggtacggattctgcaaaatggggcgtgataactacactggctcagaagctaccacataagaaaagaaggcgcatcctgaacaccgcctttaatgacaaggaggcggggttcaaactccgaaacctgaacgacacttcgtatattgcccggcttgtagctgattacacagaaacctacttggagtttctgcccttagtggagagcgaaaatacgaccctctccaagggacagaaaggctcaaagaagcacatcgcaattgtcaacggggtgctgacaagtactatgcgttattaccttggattcgcctctaaagacagagataatcatctgcaccacgctttggacgccgttatcataggtttcatgaacgatagcgtgatcaaggcattttccgacttcaaaaagacccaagagacatcaaaagcggcctattacgctcatactctcagcaagcaggaatataaaaagcagagggcctttattcaactgccgtctggcgagaatttccgcgtctccgtgctagagaaggtagaaagtgtttttgtgagcaaacctccccggaagagagtccgaggggcactgcacgaggctaccttctactctccaaacgatcctaaactcctgaagaattatggaggcacaaaaggtgtggaaagggcccttgcattggggaagatgcgcaaggtcggcgccaaaatcgtgtccaacggagctatggttcgggtggacatttttagacataagtcaagtggcaaattctacggggtacccgtctacaccatggattttgcgctgggaatcttaccaaataaggccgtggttgtgggtaaagaccagaacggcgtcataaaggattggctcgagatggacagctcgtatgaatttattttctccctgtacaaggatgacgtgatccttgtacagaaaaaggagatgcagaggcccgagctgtgttatttcgtgtcttttgacactagcggggcatcaattaaagttgctaagcacgataataacttcagtacgctaacagaaaatcaaaaactcctgttctccaacgccaccaaggaggaagtcgtgggaaagtctatcggcatacagaatttgaaagtgtttgagaagtggcaggtcagcgttctgggtgaagtgaaacgtactcagtcctaccctcgcgagaacatctcattagccagcaaggctaaaaagtga

SEQ ID NO: 2599 - RNA, 3075 nt, synthetic construct
  misc_feature 1..3075: note = Cas9 variant
  source 1..3075: mol_type = other RNA
atgatcagaaccctgggcattgacatagggatcgccagcattggatgggctgtgatcgagggtgaatacacagataagggcctcgagaacaaagaaattgtcgcatccggggttagggtgttcactaaggccgagaatcccaaaaacaaggaatctcttgcgctgcctcggacgttggctcgctcagcccgacgtagaaatgcaaggaaaaagggacggatccagcaagtaaagcactatttaagtaaagccctgggcctagacctcgagtgctttgtgcagggtgagaagctggctacccttttccagacaagcaaagattttctgtccccatgggaattgcgcgagagagcactctacagggtcctggacaaggaggagctggcccgggtgatactccatatcgctaaacgccgagggtatgatgacattacttacggagttgaggataacgactctggcaagatcaagaaagccattgcggaaaattcgaagagaatcaaagaggaacagtgtaagaccataggcgagatgatgtataaattatacttccaaaagtcactgaacgtgaggaataaaaaggaaagctataaccggtgcgtcgggcgtagtgagcttcgcgaggaattgaagacaatttttcagatccagcaggagctgaaatccccgtgggtgaatgaggaactaatttacaagctcctgggaaaccccgatgcacaatctaaacaggaaagagagggtcttatcttctaccagaggcctctgaagggctttggggacaaaatcggaaagtgtagccacattaagaaaggcgaaaattccccatatcgggcctgcaagcatgctccctcagccgaagagttcgtagcattgaccaaaagtataaactttctcaagaatctgactaaccgacacggtttatgtttcagccaggaagatatgtgcgtttacctggggaaaatcctccaagaggctcagaagaatgaaaagggacttacatattctaaactgaagttgctactggacctcccttccgattttgagttcctgggccttgactactcaggcaaaaacccagagaaggccgtgtttctgagcttgcccagtaccttcaaactcaacaagattacgcaggaccgcaagactcaagataaaatcgcgaatatactgggggccaacaaggactgggaagcaattttaaaagagctggaatctctacagctctccaaggagcagatccagaccatcaaagatgctaagctgaatttcagcaaacatattaacctttcgttggaggccctgtatcacctcctgcctcttatgagagaaggaaagaggtacgacgagggtgtcgaaatcctgcaagagcggggcatttttagtaagccacagccgaaaaatcgccagttgctgccccctctctccgaattagctaaggaggagtcatatttcgatataccaaaccccgtgctgagaagggccctaagtgaatttcgtaaagtggtcaatgcactcctggagaagtacgggggattccactactttcatatcgaacttacacgggacgtttgtaaagccaagagcgctcgaatgcagttggagaagattaacaaaaagaataaatccgaaaacgatgcggcatctcaactgctcgaggtgctgggcttacctaatacttataacaatagactgaagtgcaaactttggaagcagcaggaggaatactgtttgtatagcggtgagaagatcaccatcgaccacctcaaagatcagagggccctgcaaattgaccatgctttcccactatcacgcagtctggatgactcccagagcaacaaggtactctgcctgacatcttcaaatcaggaaaaatctaacaagaccccctacgagtggcttgggagcgacgagaaaaagtgggatatgtatgtgggccgggtctactcctctaacttttcgccgagcaagaaaagaaagttgacgcagaaaaatttcaaggaaaggaacgaggaagactttctggcccgcaatttagtggatactggatatataggccgagttacaaaagagtacatcaagcactccctctcattcctgcctcttcccgacgggaaaaaggaacacattcggatcattagtggatctatgaccagcactatgcgttccttttggggtgtgcaagagaagaacagagatcatcatctgcaccacgcacaggacgccatcataatcgcttgtattgagccatcaatgatccagaaatacacaacctatttgaaggataaagaaacgcataggctcaagagccaccaaaaagcccagattctgcgcgagggcgaccacaagctatctctgcggtggcctatgtccaatttcaaggataaaatccaggaaagtatacagaacattatccccagccatcacgtctctcataaggtgaccggggagctccaccaagaaacagtaagaactaaagagttttactatcaggcattcggaggcgaggaaggtgttaagaaagcgctgaagttcgggaagattagggagatcaatcagggcatagtggacaacggagctatggtccgagtggatatctttaaatccaaggacaaaggcaagttctacgccgtcccaatttatacctacgattttgcaatcgggaaacttcccaataaggccattgtgcagggaaagaaaaacggtatcataaaggactggttggaaatggacgagaattatgagttctgcttttcactgttcaaaaacgattgcattaagatccaaacaaaagaaatgcaggaggctgttttagccatctacaagagtactaatagcgcaaaggctaccattgaactcgagcacctgtcgaaatacgcccttaagaacgaagacgaggaaaagatgtttacagataccgacaaagagaaaaataagactatgacgcgcgagtcctgtggcatccaggggctgaaagtgttccagaaggtaaagctatctgtcctcggagaagtgctggagcataaacctcggaacagacaaaacattgcgttgaagacaaccccaaaacacgtttga

SEQ ID NO: 2600 - RNA, 3078 nt, synthetic construct
  misc_feature 1..3078: note = Cas9 variant
  source 1..3078: mol_type = other RNA
atgggcgggtacatgccccagctgatgagatataggctcgcccttgacatcggaagcacctccattggttgggctatgatacggctgtctatgcaaaacgagcctatcgcaattatccgcatgggcgtgcgaattttctcagatgggcgtaatccaaaggacggaagtagcttggccgtcacaagaagggttgcgcggcagatgcgcagaaggcgggatcgcttactgaaacgaaagactagactactcaacgctctggtgcagaaaaagtttttcccggaagacgccgatgcaaggaaagcccttgtagtgctgaatccctacgagttgcggaaggaaggcctctatcgtcagctgtccggtcctgagtttgggcgcgctctgttccacatctctcaaagaaggggatttctctcgaaccggaagacggacaaaaaggataatgactcaagcgtcttaaagaaggcaatagtggatctgcgacagcagcttgaagttgagaactgccagaccatcggcgagtggttgttcaaacaacagcagagtggcaagtccgtgcgcgccagactgagggggaagacacagaaagacaaggcttacgatttttatattgaccgggccatgatcgcgcatgagttcgatactctatgggtctctcaagcaaaatacgacccactcctgtttaatgaagacgcccgcgctattcttagagatatcctgttgtatcagaggcccctcaagcctgtgaaaccaggacgttgtaccctgatacccgacgaaagccgggcccctttagcactgccactcacacagcaagctcgaatttaccaggagcttaaccacctgagaatcaccactccggccttgggtgcgcaggccctaacagtagcacagaggaataccattgctgccctgctcgagaagtccgatgttacgttcgtgaaaatcgctaaggccctgggccttacttcaaccacagaatttaacctgcaagacatcaagcgcgatcggttgaaagggaatgcaactgccattatactcgctagaaaccagtacttcggaaggcgctggcatgactttaatgcggatctgcagaacttaatcgtcgacaagctggtgaatgagggcagtgaaaccgcactaattgagtggctcaaagccaacacagatgtggacgaaagcgctgccgagcgagtctctggtgttaccctgcccgaggggtatggatccctttcagtggcagccttgcggcgtctgctccctgctctgaaggaagatgtagtggtctacagcgaggccgtgaaaagagcaggcttcgacagtcactctgcgctttccctgatcgaacagacgggcgagttgtatcaagaactcccatactatggggaggttctgcagaggcatgtgggattcggtagcggcgaccccaacgattcgcctgagcgccggtttgggaagatagctaatccaactgtccacattggattaaacgaactgagaaagatcatcaatgccctaattaaaaggtacggcaaccccgcagaggtggtagttgaactcgcccgagacctgaaactttctcgcgagaaacggaaggaaatccaggaggagcagaaacaaagacaggataggaatgaaaagcgtattaaggacgcttgcgagatattgggtatcgatccgctggtgattgaccgcgggaaacggagagaaatctcccagaagatgcagctctgggatgagctgaaccctaaagacgccgcaaataggcgatgtccctatacaggcgatcaaatctcaattgagaagttactgagtgctgaagtcgagatagaacacatccttccattcagcaaaaccttggacgattccctcaacaataagactgtggccatgcggcgcgcgaacagagacaagggaaataggacaccttacgaggcctttggcgaatctctgaaccccgattacgactatgacgctattctacagcgggcaagcctgatgccacgagagaaaagaaagcgcttcgcctcagatgggtaccagcaatggctcagggacgataaagactttctgagtcgtgctcttaatgataccgcctatttgtcccggatcgcaaaggagtacctgacgttaatttgtccccctaacagcgtcagagcgatcccaggaaggatgaccgcccagctccgcgctatgttcggtctgaatcgacttctgtctgaaggcgggatcaaaaacagagaggaccatcggcaccatgccatagatgcagctgtgattggagttacagaccagggcttgctccagaagttttcaagggccagtgcacgcactcgtgaactgcaactaagcagactggtggatgacatgccgctcccctgggatacctatcgggagcacgtaacaagggccctggaacaccttgtcgtgtcccataaacctgaccacggttaccaggggaagatgcatgaggatactgcttggggcttgcgcgacaacggacaggttacccgaagagtgcggtctgaggacggcgggccaaggcagcgcctgttagaaaataagaacgtcgtgaaaatcaattcgacaagagatttcagcaggcacggaattgacgagcaaggtcaggtaaacgcgtataagggctacgttgggggatccaattactgcatcgaaatatggattgatgagaaaggcaagtggaactcagacgtggtcagtacctttcaggcctatcagatcgtgcgggaactcggtgagaaagcagcttggcaaaagctgcgtaatccccttctgtctctaagcgccaagcctctcgtgatgcgcctgattatcgatgacgtcgttaaaatgcagatagccgggcagaacaagatcatgcgagtggtgaaaattgctcaaaatggccagatcttctttgcagagcataacgaagccaatgtagatgcgagagacaaggataaaaacaatccattcaagtacatttccaagactgctggatcattgcagaaagccggcgggatccacatggcaataagccccattggagacgccaggccggtccggtatggccgctga

SEQ ID NO: 2601 - RNA, 3084 nt, synthetic construct
  misc_feature 1..3084: note = Cas9 variant
  source 1..3084: mol_type = other RNA
atgaagtacaccctgggcctcgacgtggggacaaacagcatcggatgggccgtccttgagctgaatactaacggtgaaccccagagaattgagaaattgggctccaggatattcacggatgggcggcaccctaaggacggaaccacattagcttctaaacgccgacaaaagcgtcatgaaagaaggcggcgcgatagactgcaccagaggaaaaagctagttctcaatcagctggtgtcaatgggcctttttccacagagtgagcaagaacagcaggaccttaagagcttggatgtactcactctgcgggcaaacggtgtgtccaaacagctgtctgcctatgagctcgggcgcgtcttctactatttaaatctgaagcgaggatttaaatcgaacagaaagggcggctcagaggaagacaaagcgaataagatcagcgagaggattaagaaacttcaagaacagttgaaggagaacgatttcaaaaccgtggggcagtacctgcatgaccggtatatcaagggactaagtacaaaagctaccattgagaatgattttcacctcctgcgtcagcttatcgaagacgagttcgattttatagttgaaactcaatccaagttctttccggagatctctgacgaacagtggaacacactgcgcaatagaatgttccatcagaggcccttgaaacctgtggagaccggtacgtgcagcctctttgaggataagaagcggacttacaaatatatgccatccttcgaagagtaccgatttctgaccgaattattcaacctgtcataccaagacgagaatttccacagtcacagcctctcttccgaacagatttttaaggtcttccatgagcttaaaaacacacgcgaggccacttataccaagatcaaaaagctgttgaagctaccctcagacctgagctttagtattgaaagatctaaatccaaggataaaatcaagataagcacaaccaatcacttcttttcgaaatctctcctgttcgcagaggaatgggcctcccttgacctgaagttgaaggatgaggtggctgaaatttacttttcagacatgagtgtagaggagatcaaaaagggcctcctgcagttaaaaattgatagcgaaatcatcgagaacctgctagaagagaaggttcctaacgtgcaggaggcaacgtgttcctattctaaagaagccctccaaaagattgtcagcctgatacttgaggaagagaggcatccaactttgatcgtggacgatctgttcaagaatgaaaaagaggagacatcactcattgaccggctggattactatggggctagtatccccgactccatgcagcctataccacagcacattaaggataacaatcttaccctgaacgaagacgagaaacgctacggaaagatcgccaatccgactgtgcacgcggcattgaaccagatcagacaagtcgttaatgacctcattgaacagtatggcaaacccacaaacatccatattgagtttgccagggatctgaagaaaagcaaggaggagcgtgacttcgataatcggaagaaaaagaaaaacgaggaattaaatgaacaggtgcgagactttatagaaaagcacaaccagaaaccttctgctttcaattttgagagagtaaagctgtggttcgaactagatgccatgaacaatcaagtgtgcgcatactcaggtaagaccatcagtgctaggatggtcctcagcgacgaggtgcaggttgatcatattctgccattctcccgcacgcttgacgattctttggccaacaaagtgctggtcctcgcgtcggagaacgtgaagaaacggaatagaaccccctacgaagcctttgggcaggacacagagaagtgggcaagcatccaggaactggctaaaaggttaccttatcacaagcaatggcgcttcgccgaggatgctatcaagaaatttgaggaaaaggaccagttcctgcagcgacatcttaacgatactcggtacatttccaaaatagccaagaaatatttgggatcaatcaccgacccatacaagattgtagcaagtcgtggccaaatgacatctatcattagaggcaagctcgggctgaatcagtttatccagaaacccgacggaactaagaacagggaggatcaccgccaccatgccatagacgctctaaccgttgcgctgacaagccggtcctatctcaaaagaatctcagatgcaagcgccaggaatcaggacccgaaccgcattcctatccccgaaccatggaagggtttcattaaagatgctgacgtgaagtttaatgagatcatagtctctcacaaagtggatcatggcaagaacgggcctttcatggaagagacctgttttggactgattaagaatcccaacaaatacgaggaagagaatgacttcaagctgatcactacgaaatccttggatagtgtcaaggacccaagcacaattcgatctcaatccctgcagaacttagccgaaaaatcaggcgtgatcagtctcgcaaagagcggtgttaagaaactgcgggtgtatgatgtaaccaaggagaatcccgccgacatagggcttatcgaatcgggcctggctaaaattactcacggaaaggataaacagcacgtcaagcattaccagaagggcgacatcaactacttggccatttggtgcctccctcaaaatatcaccctgaaatccgacaaccacaagaaaagaaagacagattatatatttaccgcaattaaaactttcgacctaaactctaagaatccaaacgatctgaggccgcatcccgcggctaagctcgtgacaaaagtttacaagggggacacggtggccctggaggtcaataaccagcttaattattacatcgtgaaaagcatccgtgcagccaacaagaaattgtattttctgaagattaatcagtcaagtgagttagctaacgaaacccagttcatccctgcctacactaagctcgtagattataaattccgcaaggtgtccgtttctccaacaggagtcattaccgacaatggtcccctgcttaaatga

SEQ ID NO: 2602 - RNA, 3090 nt, synthetic construct
  misc_feature 1..3090: note = Cas9 variant
  source 1..3090: mol_type = other RNA
atgagaagcctgaggtaccggctcgcccttgacctgggctccacctctttggggtgggctttattccgcctggatgcatgcaaccgacccacagccgtgatcaaggcgggagtccgtattttctcagacggtagaaatcctaaagatggcagtagcctagctgttactaggcgggccgcacgcgccatgagaaggcggcgcgaccgactcctgaagagaaaaacgaggatgcaggctaaacttgtggagcacgggttctttccagcagatgccggaaaacggaaggctctggaacaattgaacccgtatgccctccgtgcgaagggcctgcaggaggcactgctccccggtgaatttgcccgcgctttatttcatataaatcagagaagggggttcaaatccaaccggaagaccgacaaaaaggataatgactctggagtactgaaaaaggccatcggccagcttcgacaacagatggcagagcagggctcgcgcacagtgggggaatacttgtggactagactgcagcaaggacagggtgtcagggctcggtatcgcgagaagccttacaccacagaggaaggcaaaaagagaattgataaatcatatgacctatacatcgatagggccatgattgagcaggaatttgacgcgctctgggccgcacaggctgccttcaacccaaccctgtttcacgaggctgcccgtgcagatcttaaggacactctgttgcatcaacggcccctccgacctgtgaaaccagggagatgtacactgttacccgaggaagagagggcccctctggctctcccaagcacccagcgcttccggatccaccaggaagttaatcatcttagactgttggacgagaacctaagggaagtggcgctgacgctcgcacaacgcgatgccgtcgtgactgctctggagaccaaggccaaacttagttttgagcagatacgaaagctgttgaagctctccggatctgtacagttcaatctggaagacgcaaaacggacagagttaaagggcaacgccactagcgctgccctggcacgtaaagaactatttggtgcggcttggtccgggttcgatgaggccctccaggacgaaatcgtttggcaactggtgaccgaggagggagaaggcgcacttattgcctggttgcagacacacaccggcgtcgatgaggctagagcccaggcaatcgtggacgtgtcactgccggaagggtatggaaatctcagtaggaaggctctggcccgcattgtccccgcgcttcgggccgctgttatcacgtacgataaagcagtgcaggccgctggtttcgaccaccatagccaactgggctttgagtacgatgcctctgaagtagaggacttggtgcaccctgagactggggaaataagatccgtcttcaagcagctcccatattacggaaaggcactgcagaggcatgtggcgtttggctcaggtaaacccgaggatcctgacgaaaagcgatatgggaaaattgccaacccaacagttcacatcggcttaaatcaggtgcgcatggtcgtgaacgctctgattcggagatacggaaggcccaccgaggtagttatcgagctagcccgtgacctcaagcaaagccgcgaacagaaagtggaggcacagcggagacaggctgataatcaaaggcgaaacgcccggatccgcagaagtattgcagaagtcctgggcataggggaggaaagggtgcggggatctgacatccagaagtggatttgctgggaggagctttccttcgatgccgctgaccgaagatgtccgtatagcggtgtccagatctcggcggccatgttgctgtctgatgaagtggaggttgaacacatactccctttttccaagactctggacgattcattaaacaatcgcacagtggcaatgaggcaagctaaccgtattaaacggaatagaaccccctgggacgccagggccgagttcgaagctcagggctggagttacgaggatatcctgcagcgcgcagagcgaatgccacttagaaagcggtataggtttgcccctgacgggtacgaacgctggttgggagatgacaaagatttcctcgcgcgtgctctgaacgacacgagatacctaagccgggtagccgcagagtatctgaggctcgtctgccccggcacccgcgtgatcccaggtcagctgacagcccttttgcgagggaagtttggcctgaatgacgttttaggactcgatggcgaaaagaacagaaatgaccatcggcaccatgctgtggatgcatgtgtcattggggtgactgaccaaggactgatgcagaggttcgccaccgcgtccgctcaggcccgcggtgatggccttacaagactggtagacgggatgcccatgccttggccaacttacagggatcacgtggagcgggcagttcgtcatatctgggtctctcaccgcccggaccacggatttgaaggcgccatgatggaggagaccagctatggtattcgaaaggatgggtcaataaagcagagaaggaaagctgacggcagtgccggacgggaaatctccaacttgattcgcatccatgaggcaacacaacccctcagacacggcgtgagcgctgatgggcagcctctggcctacaagggatatgtgggcggttctaattactgcatcgaaattaccgtcaacgacaaagggaagtgggagggagaggttatatcaactttcagggcgtatggcgtggtgcgggccggtggcatggggcgactaagaaatccacatgaaggacagaacggccgcaaactgatcatgaggctcgtaattggggatagtgtccggctggaggtggacggagcagaacgtacgatgagaatcgttaagattagcggctccaatggtcagatctttatggctcccatacacgaggccaacgtggacgctaggaatacagataaacaagacgcattcacctacacttctaagtacgccgggtcgcttcagaaggccaaaacccgccgggtcacaatcagccctattggagaagtgcgagatccaggcttcaagggttga

SEQ ID NO: 2603 - RNA, 3090 nt, synthetic construct
  misc_feature 1..3090: note = Cas9 variant
  source 1..3090: mol_type = other RNA
atgaagtacagactggccctcgaccttggcagcacctccctggggtgggctatcgtgcagttgaacgcaaaagatgagccctgcgccattgtcagggcgggagttcggatattccctgacggtcgcaatccaaaggatggatcttcattagctgtgacacgacgtaacgccagagcaatgaggcggcgcagagacaggctgctaaaacggaaggcccgcatgcaacgactcctgatcgaacacgatctttttccggctgacgaggcagccagaaaagctctggaaactttgaatccctatgagctcagggccaaggggctggatgcggcactgacgcctgccgaatttgctcgggccctctttcatttaaaccagcgtcgcggattcaagagtaatagaaggaccgaccggaaagataacgacagcggcgcactgaaggctgccattggtgggcttcgagcgcagttggatacagccggagcagacggccgcgctagaactgtaggcgagctgctatggaggcggatgtccgatccaaatgtgctcaccgtccgcgccagatacagggagcagcgtatcacaaaagacgacgggaagacccgggtggataaatcttatgacctgtacgttgatcgagctatggtggaagccgagtttgacgcactttgggccaagcaagctgaactgtcgcccactcagttcggagaggcggcaagagccacattgaaggattgtctcctgcaccagaggaacttacgccctgtccggccaggtagatgcaccctggagcccgacgaacctagggctccactcgcccttccgtcacagcaacgctttcggattctgcaggaggtgaatcatttgcgactactgggcgggcgtctcctggaagagagccttagtgtagaacagagagataaactggttgcagccttggaggacggatccaagtctttcaaaacggctatccccaagctcctgggcttacctggtactgtgcagtttaacctggccgatgcaaaaaggaccgagctaaaggggaatgcgacaagcatgctcctgggcaaaaaggacttctttggcccagcttggcacggcttctccgaagcccgccaagatgagatagtcatgcggatccaggaagaggaatcagaggcaagacttgtggactggttggccaccagtactggggtggacgaggctcatgccctgaagattgcaaacgctgccctccccgaaggatatggtagcctgtctgcgaaagcccttgctaagatcctgcctgcaatgagggccgaggtcattacatacgataaagctgttttggccgcaggctatgaccaccactcccatatctcacacgcggccagcaccggggaaatactcccagagctgccctactacggagaatatttacagcgacatgtgggctttggtacgggggagctgaatgatactccggagaagcgcttcggccggattgctaaccctacagtacacatcggactaaatcaagtgagagtcgtggttaacgccctcattaaaaggtacggccaccccaccgaagtgatcgtcgaggtggcacgtgacctgaagcagagtcaggatcagcgccgggaaactcaagagcagcaggctaagaaccagaaaagaaatgagaggcttcgaaaggacgccgcagccatcttggggattgctgatgaacgggtacgcctggcggacatacaaaaactcatcctgtgggaggaattatctttcgatattgccgacagaaggtgtccatattccggagttcagctgagcgcagctatggtgctttcggagcaggtcgaaatcgagcatatattgcctttttctatgacactcgatgactccctgaacaataagaccgtggccatgcggctagtcaaccgactgaaaggtaatagaacgccctgggatgcccgcgaggctttcgcaggccaggggtgggactacgacgggattctcatgagggccgaacgtatgccacgggcgaagagacaaaggtttgctcccgatggcctggagaagtggcttaaagaagacaaggatttcttggcccgcgcactgaacgacacccgacacttatcaagagtggcccgggagtatctcagtctggtttgccctgctagcacaagggtgatcccaggtcagatgactgcaatgcttcgcgccaaatttgggctgaatgatatcttgggcctcaacggagaaaagaatcgtaacgaccatagacaccatgcggtagatgcttgtgtcgtggccgttaccgaccagggcctgctacagcggttcgcacaagcctccgctgatgccagggggaaaggactggaccgcctcgtggagacaatgccggatccctgggactcttaccgagagcacgtccagagagcagtgaatagcatttgggtatcacacaagcctgatcatggttttgaaggcgctatgcacgaggacactacctatcggccaccccatctggaccctaagaacatgtggaggacacgcgggatcggaggcggtaaaccaaatgaaaaggaggccgatagtaaagcgatggtggggttcaccggccccgaacaccttcagagacaccatagggacaaggccggacaacagttgccgtacaaaggctacgttgcatcccctaagttttgcatggatattgtccggaacgacaaagggcgttgggagggagaggtggtgagcactttcgaggcttatcgcctggtctctgaatttggccgagatgccgctttagcacacatacagtcaaagagtagaagcatctccggtaagccactcgttatgaggctgcagggaggagacatggtgcggttcgatgacgatgaaggccgccccgtggtacttagagtcgtgaatatgacgggtaacggccaaattttcttcgcccctcataacgaggccaatggggacgctaggaaccgggataaacaggaccagttcgtttacctgtctaagtatgcgggatcgctacagaaagcacgaggcagacgcgtgacagtcagccccgccggggagctcagggacccaggatttaaggaatga

SEQ ID NO: 2604 - RNA, 3090 nt, synthetic construct
  misc_feature 1..3090: note = Cas9 variant
  source 1..3090: mol_type = other RNA
atgagaagcctgaggtaccggctcgcccttgacctgggctccacctctttggggtgggctttattccgcctggatgcatgcaaccgacccacagccgtgatcaaggcgggagtccgtattttctcagacggtagaaatcctaaagatggcagtagcctagctgttactaggcgggccgcacgcgccatgagaaggcggcgcgaccgactcctgaagagaaaaacgaggatgcaggctaaacttgtggagcacgggttctttccagcagatgccggaaaacggaaggctctggaacaattgaacccgtatgccctccgtgcgaagggcctgcaggaggcactgctccccggtgaatttgcccgcgctttatttcatataaatcagagaagggggttcaaatccaaccggaagaccgacaaaaaggataatgactctggagccctgaaaaaggcaatcggccagcttcgacaacagatggctgagcagggctcgcgcacagtaggggaatacttgtggactagactgcagcaaggacagggtgtgagggcccggtatcgcgagaagccttacaccacagaggaaggcaaaaagagaattgataaatcatatgacctatacatcgatagggcgatgattgagcaggaatttgacgccctctgggcagctcaggccgctttcaacccaaccctgtttcacgaggccgcacgtgccgatcttaaggacactctgttgcatcaacggcccctccgacctgtcaaaccagggagatgtacactgttacccgaggaagagagggctcctctggcgctcccaagcacccagcgcttccggatccaccaggaagtgaatcatcttagactgttggacgagaacctaagggaagttgcactgacgctcgcccaacgcgatgctgtggtcactgccctggagaccaaggcaaaacttagttttgagcagatacgaaagctgttgaagctctccggatctgtgcagttcaatctggaagacgccaaacggacagagttaaagggcaacgctactagcgccgcactggcgcgtaaagaactatttggtgctgcctggtccgggttcgatgaggcactccaggacgaaatcgtatggcaactggttaccgaggagggagaaggcgcccttattgcttggttgcagacacacaccggcgtggatgaggccagagcacaggctatcgtcgacgtgtcactgccggaagggtatggaaatctcagtaggaaggccctggcgcgcattgtgcccgcccttcgggctgcagtcatcacgtacgataaagccgttcaggctgccggtttcgaccaccatagccaactgggctttgagtacgatgcatctgaagtggaggacttggtacaccctgagactggggaaataagatccgtgttcaagcagctcccatattacggaaaggcgctgcagaggcatgtcgcctttggctcaggtaaacccgaggatcctgacgaaaagcgatatgggaaaattgctaacccaacagtgcacatcggcttaaatcaggttcgcatggtggtcaacgccctgattcggagatacggaaggcccaccgaggtggtaatcgagctagcacgtgacctcaagcaaagccgcgaacagaaagttgaggctcagcggagacaggccgataatcaaaggcgaaacgcacggatccgcagaagtattgccgaagtgctgggcataggggaggaaagggtccggggatctgacatccagaagtggatttgctgggaggagctttccttcgatgctgcggaccgaagatgtccgtatagcggtgtgcagatctcggccgcaatgttgctgtctgatgaagtcgaggtggaacacatactccctttttccaagactctggacgattcattaaacaatcgcacagttgctatgaggcaagccaaccgtattaaacggaatagaaccccctgggacgccagggctgagttcgaagcacagggctggagttacgaggatatcctgcagcgcgccgagcgaatgccacttagaaagcggtataggtttgcgcctgacgggtacgaacgctggttgggagatgacaaagatttcctcgctcgtgccctgaacgacacgagatacctaagccgggtggcagccgagtatctgaggctcgtatgccccggcacccgcgtcatcccaggtcagctgacagctcttttgcgagggaagtttggcctgaatgacgtgttaggactcgatggcgaaaagaacagaaatgaccatcggcaccatgcagttgatgcctgtgtgattggggtcactgaccaaggactgatgcagaggttcgcgaccgcttccgcccaggcacgcggtgatggccttacaagactggtggacgggatgcccatgccttggccaacttacagggatcacgtagagcgggccgtgcgtcatatctgggtttctcaccgcccggaccacggatttgaaggcgctatgatggaggagaccagctatggtattcgaaaggatgggtcaataaagcagagaaggaaagccgacggcagtgcaggacgggaaatctccaacttgattcgcatccatgaggctacacaacccctcagacacggcgtcagcgccgatgggcagcctctggcgtacaagggatatgtgggcggttctaattactgcatcgaaattaccgtgaacgacaaagggaagtgggagggagaggtcatatcaactttcagggcctatggcatcgttcgggctggtggcatggggcgactaagaaatccacatgaaggacagaacggccgcaaactgattatgaggctcgtgatcggggatagtgtgcggctggaggtagacggagcagaacgtacgatgagaattgtcaagatcagcggctccaatggtcagatatttatggcccccatccacgaggctaacgtggacgcaaggaatacagataaacaagacgccttcacctacacttctaagtacgccgggtcgcttcagaaggctaaaacccgccgggttacaattagccctatcggagaagtgcgagatccaggcttcaagggttga

SEQ ID NO: 2605 - RNA, 3096 nt, synthetic construct
  misc_feature 1..3096: note = Cas9 variant
  source 1..3096: mol_type = other RNA
atgcccgccatctacagactggctctcgaccttggcagcacctccctggggtgggcagtgttgaggttagagcctgccgcgctggaaccaattgctataatcaaggccggagtccggattttctctgatggtcgcaacccgaaagacggcgcatcactagccgttacacgacgtgctgcaagagccatgaggcggcgcagagataggctcctgaagcggaaagctcgcatgcaggacaaacttgtgaaacacgggtttttccccagtgatatggacgagcgaaaggccctggaaagattggatccttatgcgctcagggcaaagggactgcgggaggccctgactccaggcgaatttgctcgtgccctcttccatatcaatcaacgcagaggttttaaaagcaacaggaagacggacaaaaaggataatgactccggggcattaaagaaggctatttctcacctgagacagcagatggaggccggaggccatcgaaccgtaggcgatcacctttggtcgcgcttgcagcaagggctgggagtgagagcgaggtaccgggagacacccttcactaacgacgaaggtaagaaacgcatcgataagtcatatgacctatacatagacagagccatgatcgagcaggaatttgatgcactctgggctgcccaggctgccttcaatcctgcactgtttcatgaggtcgccagggctgaccttaaagataccctgttgcaccagcgtcggctccgaccagtgaagcccggcagatgcacactgttacctgaggaagagagggcgccactggcactcccgagcacccaacgcttccggatttatcaggaagttaaccaccttagactgttgggggaggacctaagggaagtggccctgactctcgctcagcgcgatgccgtcgcaaatgccctggagagtaaagctcgacttacatttgagcagatccggaagctgttgaaactctccggatctgtgcaattcaacctggaagacgccaagcgtaccgagttaaagggcaatgcaacgagcgcggctctggccagaaaagaactatttggtgcagcctggggagggttcggcgaggctctccaggatgaaattgtatggcagctggttactgaggagggcgaaggggcccttatcgcatggttgcaagctcataccggagtggacgaggccagggcgcaggccatagctgatgcatccctgcccgaaggttacggctcactcagtcgcaaggccctggctcggattgtccctgcccttagagcaggggtggtgacatatgacaaagcggtccaggccgctggattcgatcaccatagccagctgggctttgagtacgacgccggtgaagttgaggactgggtgcacccagatactggggagatcaggcccgtattcaagcaattgccttactatggcaaaccactccagcgacacgtggcatttggatctggcaagcccgaagacccggatgagcgccggtacgggaagattgctaaccctaccgtccatatcggactgaatcaggtgagaacagttgtgaacgccttaatcaggcgttatggtcgccccaccgaagtcgtgattgagctggcacgggacctaaaacagtccagagagcaaaaggtagaagcccagaggaaacaggctgagaatcagcgacggaacgcgcgcataagaaagtcaatcgccgaagttctcggcattggggaggaacaagtgaggggagcagatatccagaaatggatatgttgggaggagctgagcttcgacgtcgctgaacggcgatgcccatacagtggcgtgcagatttctgccagaatgcttttgtccgatgaggtcgaagtggagcacatcctgccttttagcaagacgctcgacgattcgctgaataaccgcactgttgccatgaggcaggctaaccgtatcaagcggaatagaacaccctggaccgcaagggacgatttcgaagcccaaggttggtcttatgaggggattttacagcgcgcggagcgaatgccactgagaaaacggtacaggtttgctcccgacggctatgaacgctggcttggagatgacaaggacttcttggcccgtgcactcaacgatactagatacctgtcccgggtggccgctgagtacctaaggctggtatgtcctggctcagggacacgcgtcatcccaggacagatgaccgcacgactcagaggtaaatttggcctgaatggggtgcttggaccggacggcgaaaagaaccggaatgatcataggcaccatgccgttgacgcgtgcgtgattggtgtcacggatcaagggttgatgcagcgcttcgctaacgccagtgcacaggccagagaggacggcctgaccaggttagtggatgacatgccccggccttggccaacatatcgtgctcacgtagaacgcgccgtgcgacacatatgggttagccatagacccgatcacggatttgagggcgcaatgatggaggaaacttcctacgggatcggaaaagacggctctattaagcagaggcggaaggctgatggtagccctgggcgcgagatcaccaatctcatccggattcatgaagccacacaaccacagaggcacggagcgggccccgacggtcagccgctgccttataaaggctacgtcgggggatcaaactattgtatagagatcactcggaatgataagggcaaatgggagggggaagtgattagtaccttccgagcctacggaatcgtgagaacatccggccttggtcagctgcgccacccaagggtcgggcaaaacggacgggagttggttatgcgtctcgtgattggcgacagcgtgagactggaaatcgacggtatagagaggaccatgcgcatcgtaaagatttctggctcaaatgggcagatctttatggcacccattcatgaagctaacgtcgatgcccggaatagtgacaaacaggatgctttcgcatatactagcaagtacgccggatccctacagaaaacgaaggcccgattcgtgacaatctctcctataggcgaggttagagacctggggtttaagggatga

SEQ ID NO: 2606 - RNA, 3099 nt, synthetic construct
  misc_feature 1..3099: note = Cas9 variant
  source 1..3099: mol_type = other RNA
atgaagaaaagaatcctgggcctcgacattgggatagccagcgtgggatgggctcttgtcgagttcgatgacgaatttcaggataacaagaaaaagggtaccatcattaaatccggcgttaggatcttcacacgggcagagactcccaaggaacgcgagtctctggccaagcctcgacgtgaagcgagatcacaaaggcggcgcattagaaggcgggtggagcgcttgaatagtatccgagagttatttgtaaagaacggggtggtcgaagagtggagcgtgtccaagaaaaatccaaacaatatatacatcacgctgaaccagattaagaccccgtggcagctaagaatggaatctctcgacaggaaactgacaaatgagcagttcgctgttgtgcttactcacctggccaagcatcggggatataagtcgttgcgtaaagatgacaaggcaggcaaagtcctcgaggccatctcacaaaacaagaaacgcctgaatgatagcgactacagaaccctgggtgaaatgttttgcaagaacgagagttataaagaacacaagaggaataaagggggagagtacattaactccgtggctcgggaactcatcgaggaggaagtagagaaaatattcgttaagcagcgagaaaaaggcaataactttgcagatgtgaatacagagcgcgaatatttaaagattgccttctctcagaaacccgctggcagcatctccaagatggtcgggttttgtaccttcgagaacggagagaagagagcccctagggactcatacagtgcggaactgtttaaagtgctttgcactattaacaatacaaccttcacggatatgaagactggtgagatccggagcttttctaaagaagagatcggcaagaccttggaaacagtgaaaaacgtcaaggacgttaagtatgcaaaaattcgcaaggatctggggctagaggactccgtgaaattctcaggagtagactacagagagaatgccaagagcaaaggcgaaggtgagatattcgtgagtatgaagacttaccatgaaatcaagtctaaaattgagaagctctccaaagagaagtgggataacctgaaagggaataccgaacttctggacagcatcgtcaacataattgctaatttgaaggatgacgagtcgatcaaaaaggaatttcagaagctcaaaatcgatgaggacattatcgatgtgctgttaaacttcgaatttaagaaattcattaatctgtcttttaaggccctcaggaaaataatcccattccaatttcagggacagaagtatattacagcatccacctcagctggctacagtcttaagcaggagggcatcaaaaacaagctggttccccctgccaaagagaatatcaacgtggcggtcgtggcccgtgcattcgctcaaacgcggaaggtaattaatgccgttatacgaaaatatgggcagtttgaccagatcaacattgaattggctactgagctaaagaatagcaagttcgatagatccaaaatcgaagagggacaaaagaaatttcagtctcagaaggacaaaattttcaaggaagtgcaggagctgaggggtggcatgacaccaagctcaagtctcctgcttaagtaccgcctgtggcgggagcaagatgaaagatgtgtctattccgggaggaaaatcagctttgaggacttgctcgacaccggattcctggatatagaccacatcattccctactctaagtcaatggatgacagtttcaacaacaaagtgttatgcctggccgaagagaatcgcaacaagaaaaatgatatcccttttaactattaccagcgaattgaccgggattggaatctactcatcagcataattacttccatgaagaacatgaaaatcgcaaagaagtctcgtctgcttaaacaggaattgtcggacattgagggcttcatcgagagaaatataaacgatacaaggtacgccacccgctatatcaaggactttctggaaaataacctcgagttcaaagaaaatgagtttattaaggtcaaagtgcaggctcggagcggtgggctgacgtccgttctttcatacaactggggcatgagtaaggatagagaggaatcttatttccatcacgcgaaggacgcaatcattgtggcctgtagcacccaaggaatggtacagtacatctccaaaatatcacagcagtatgagaatgataaggacaaaatgaagaaaattaaggacaagacagaaaactgcatcccaaaaccgtgggatagctttagggctgacgtcgaggaatctatcgagggcattttcgtgtcctttgcaccccgacacaaggttactgggagtgcccataaagagaccatctacagcaagaaacacctggaaaaggagcgctatgtgacagtcaagaaatctttggataagattaaactctccgacctggaaaatataccttgtaacgagaactgcggaatcattcgggtgttaaaggaaagactggagaaattcaagaatgattcactaaaggcctttgctgacccagtacatatgcccactaaatgtcctaacaagaaaggtccagtgatcaggagtgttaagattaaagagagcaataagaccggcatcgaagtccgtaaagggctcgccgagcgcggagaaatggtgcgggtggatgtcttcataaaggacaagaaatactacctggttcccatctatgtgtcggattttaagaacaaagaccttccgaataaggcaattgcggctttgaaactggagaacgaatggatcatgattgataagacatactccttcaagttctctctctttaaagacgatctgatcaagattaaaaagaaaaaggaggagatattcggctattttggtggggtgcacagaagcaccggcactatcaagatcaaatcaaggcacaagcctaaagaaattgacgagggaataggcagtcgatgcttactggacttccggaagtttcaagtagatgtccttgggaattacacggaagtgaaacatgagaagcgcatgcccgcctatatcacaagaaaggacaaaaagcactga

SEQ ID NO: 2607 - RNA, 3105 nt, synthetic construct
  misc_feature 1..3105: note = Cas9 variant
  source 1..3105: mol_type = other RNA
atgaagatcctgggcttcgacattgggatagccagcatcggatgggcttttgtggagaacggtgaactcagagattgcggcgtcaggattttcaccaaagcagagaatcccaagacaggggactcccttgccatgcctcggcgcgaagcgcgatctgttcgtagaaggctggctcggcgcaaaggaagattggagactttaaagaggctgctagccaaagaatgggatctctgttacgaggactatatcgcagccgatggcgagctgccaaaggcttttatgggtaagaaccttacgaatccgtacgtgctgcggtatgaagcattgcagcgcctcctggggaaagaggaactggcccgagtaattctccacatcgctaagcatagaggatacggcaacaaaaatgccaagataaccaaatcagaggagagtaagagggaacaaggcaagatcttaagcgcgctggcaacaaacgcctccgtgattgctcggtatcgtactgtcggggagtacttctataaagaattttgcgaggtgatcaagaatccccagggacttaacaccaatgaaaactgtacacagcctaaagttcgcgtgttgaagccaattagaaataaaggtggcgagtacaccaactgcatcctgcaggaggacctacaaagggaactccggtgtatattcgagcaccagaaggggtttggattccccattactcaggaatttcaggataaaatcctgaagattgccttctaccaacgatctcttaaggacttttcgcatctggtcggcaaatgcacattctatcctgatgagccacgcgcacccaagttttcattgagcgctatcgagttcatcaccaaagccaagacgattaatctcctggtgggtatagtaaaagagagtggggaggtttgggacaaggaacagtggagagagaggttagattccgtgttctctgcggtctgtgaacggggaaacctgacttttgcccagatgcgcaagatcctcaaaattgacgagagaatccagttcaaggaagtggattacaccgcaaagaatcctgagaacaagaaatttgtggagttcaagaaccttaagaaattttgcgaaatactgggcgctattgtcggcgacagggccttggctgacagcatcgcccgtgatatgacactaatcaaggacgaggaagaactggcacaaaaactccgggggtatggaaagttctcccaggagcagattactcaactgggtgcccttaatttttcacaccatatcaacctgagtttgaaagctctcagcgaaattctgccattcatgcgagagggcatgagatacgatgaagcgtgtcaggaggcaaagttacaggccaagcacaatgacaaaaagtctaaatttctgccgcccttctgcgggtccatatatgctgatgaactaaccaaccctgttgtgcacagggccatcgcagagtaccgcaagattctcaatgccctgatcgctaaatatggaaacgtacataagatccacattgagcttacacgggacgtgggcaaaaattttcaggaaagagagaagtacaagaaagaaatagagtcaaactacaaggccagggtccaagcaatgcaggaatgtgagaaattgggtctgaccctcagcgaggggaatatcctgaaacttcgcctgttcatggaacagaacgagcgatgcgtgtatagtggccggaaaattacgttggcgaatctcaaggaacagggagctctggagatcgatcatattttaccatactctcgttccagcgacgattcgtatatgaacaaggttctggtgtttactaatgaaaaccaaaataaaggcaacaagacaccctacgaggccttcgggggagactctcagaaatggggtgagatcgaatccctagcactcagatcaggctatcctaagaaaaaggccaagaggatactggataaagggttcggagaccgcgaggctggctttaagagtcggaacatcgtcgacagcggttacattgccagacttatcgcaaattataccaaagaatacttgaagttcctgccactcgattcccacgagaacactgctctgattgccggggagaaagactctaagatccacgtggaagcggtaaagggcatgttaacagccaccatgaggcatttttggggactgggcagcaaaaatcgatacgagcacacgcatcacgctatagatgcaattatcattgcctatatcaacgctgccatgatacagcgcttctcacagtttcggcaaaatcaggaaagtcttaaggcaagattctacgcgaaagagttggccaaggaagagtttaaaacccagagggctttctttgagcccttctccgggtttcgtgaacaggttctcgccaaggtgggacaaatcttcgtcagccgcccgcctcggaaaagagcaaggggtgctctgcatgaggaaacattttattctattgacgataagaagctatcagagacttacggcgggaaagaaggagtgcagcgagccctgagtctcggcaagatccggcagattggtaccaaaatcgtcgcaaacgggcccatggtgcgcgttgacatattcaagcacaaaaagagcggcagattctatgccgtgccaatttacacaatggattttgctctgggaatccttcctaataaggcggtagtctccggcaaagacaacgataggatcattaaggactggttggagatggattctaattatgagttctgcttttcgctgttcaaagacgatgtgatcgaagttcaaaagaaagacatggagaagcccgaattagcctactttgtgagcctcaacacttcctcagcaagtattgctctggtcaagcacgacaataaattcgagacccttacatctaaccaggccaagctgtttagcaatgccaaagaaaacaatgtgatagctgagtccttggggatccagaacctcaaggtattcaaaaagtacaaggtgtcaccactgggagagattaaagaagcaaagtatgagccccggcagcctatcgccctaaaaaccagcccaaagaaacatcgaaagcaaaacaatgcgcagtga

SEQ ID NO: 2608 - RNA, 3108 nt, synthetic construct
  misc_feature 1..3108: note = Cas9 variant
  source 1..3108: mol_type = other RNA
atgagaaggctgggcctcgaccttgggaccaacagcatcggatggtgcctgttggatttaggtgacgatggcgagcccgtgtccattttccggacaggggcccgcatattttctgacggacgagatcctaagtcactgggcagtctaaaagctactcgtagagaagcaaggctcacgcggcgcagaagggaccggttcatccagcgccaaaagaatctgattaacgcccttgtcaaatacggtctgatgccagcggatgagatccagcgacaggctttggcctataaggacccgtaccccattaggaaaaaggcactcgatgaagccatcgacccttatgagatggggagagctatatttcacatcaatcagcggcgtggattcaagagcaaccgcaaatccgcagataatgaagccggcgttgtgaagcaatctattgctgacctggagatgaaactgggcgaggccggggcgagaaccatcggagaatttctcgcagataggcaggccacaaacgacactgtacgggctcgacgcttatcgggtaccaatgccctgtacgagttctatccagacagatacatgcttgaacaggagtttgatacattgtgggcaaagcaggctgccttcaacccctcactgtatattgaggcggccagggaacggctaaaagagatcgtgtttttccaacgcaagctcaagcctcaggaagtcggcagatgtatatttctgagcgacgaggataggattagtaaagcacttccatccttccagcgttttcggatctaccaggaactgtctaatttggcttggattgaccatgatggggtggcccaccgaatcaccgctagcctcgccctgagagaccatttattcgatgagctggagcacaagaaaaagctcactttcaaagcaatgagggccatccttcgcaagcaaggagttgtggactaccccgtcggctttaacctggaatccgataatcgggaccatttgattggtaacctaacatcatgcataatgagagatgctaaaaagatgatcgggagtgcgtgggacaggctggacgaggaggaacaggatagcttcattctcatgctgcaggacgatcaaaagggagacgatgaagtgcgctctatccttacccagcagtatggcctgtccgacgatgtagcagaggactgtttggatgttcgactccctgacggccacgggtcactgagcaaaaaggccatagatcggattttaccagtgctgcgtgaccagggactaatctactatgatgctgtcaaagaggccggtctcggcgaagcaaatctgtacgacccgtatgccgctcttagtgacaagttggattactatgggaaagccctggcaggacacgtgatgggcgcgtctggtaagtttgaggactccgatgaaaagagatacgggacgatcagcaaccccactgtgcatattgctctcaatcaagtcagggccgttgtgaacgagctgatccgccttcacggcaaacctgacgaagtagtgattgagataggacgggatctgccaatgggcgcagacgggaagagagagttggaaaggttccagaaagagggacgagccaagaacgaacgcgctcgggatgagctcaaaaagctgggtcatatcgactcgagagagtctaggcagaagtttcagttatgggaacaactggccaaagagcccgtcgatcgttgctgtcctttcaccggcaagatgatgtccatttcagacctatttagtgataaagtggaaatcgagcacctcctgccattcagccttacattggacgattccatggcaaataagactgtttgctttcgccaggctaaccgggacaaagggaatagagcccccttcgacgcgtttggaaactctccggccggctacgattggcaggaaatcctgggtaggagccagaatctcccttatgctaagcgatggcggttcctgcccgacgcaatgaagcgctttgaggccgatgggggcttcttagagagacaactgaacgacaccaggtacatttcacggtatacaaccgaatacataagtacgatcattcctaaaaataagatctgggtggtcactggacgacttacatccttgctcagaggcttctgggggctgaacagcattctacgcggacacaataccgatgacggtactccagctaaaaagtctagggatgaccatcgtcaccatgccatcgatgcaatagtggtaggcatgacatcacgggggctgctccagaaagttagtaaggcggccagaaggagcgaggacctggatcttacccgcttgtttgaaggacgaatcgacccctgggacggcttcagagatgaggtgaaaaagcacattgacgctatcattgtctcccatcggccaaggaagaaatctcagggtgccctgcacaacgatacggcatatgggatcgtggaacacgctgagaatggcgcctcgaccgtcgtgcatcgcgttcccataactagcttaggaaagcagtccgacattgagaaagtgcgtgatcctctcatcaagtcagcactgcttaacgaaacagccggcctgagtgggaaatcttttgagaatgctgtacaaaagtggtgtgcggacaacagcattaagtccttgagaatcgtcgaaaccgtgtcaataatcccaattacagataaagagggagttgcctacaagggctataaaggtgacgggaatgcatacatggatatctaccaggacccgactagctctaagtggaaaggagaaattgtgtcccggttcgatgctaaccagaagggctttatccccagttggcaaagccagttccctaccgccaggctcataatgcgcctgcgaattaacgacctactgaagctccaggatggtgagatcgaggaaatctatagagtccagcggctgtctggctccaaaattcttatggccccacacacagaggctaatgtggacgcaagggaccgcgataagaacgacacctttaaattgacttcaaagagtcccgggaaactgcaaagcgcctcggcgagaaaggtacatatctcccctacgggattaattagggaaggctga

SEQ ID NO: 2609 - RNA, 3108 nt, synthetic construct
  misc_feature 1..3108: note = Cas9 variant
  source 1..3108: mol_type = other RNA
atggagcagctgaactacatcctcggccttgacattgggatagccagcgtgggatgggctgtcgttgaaatcgatcacaatgaggaccccattagactgatcgatgtgggtgtaaggaccttcaacaaggcagaagtggccaaaacaggcgagtccttgtctttaattcggcgcctggcgcgagggtcacgtagactggtcaggcggaagaaaatgcgcctcctgactgctaagagacttctgaaaagtgaaggaatcttgagcgacctcgattttaataagggcgccatactgaacctgcctaataactgctgggagctcagggtgaagggtttagacaaaaagctgtccgataaagagtgggcagccgttcttttgcatatcattaagcaccgggggtatctgtctcagcgcaaacatgaccgaaagacggatgacaaggaactaggagctctcctgtcgggcgtgtcaaagaatcacagccttctggaggaaggcgagttcagaaccgcagccgagttggctatcaacgtcttttgtaatagtaaggggcatattaggaaccagtggggagattactcccacacattctctcggctcgacctgcagaaagaaatcaagcagttatttgtgagccaacgtgagctgggtaatccatatacttcctcaagtttcgaagagaacataattagcctccttatgaaacagaaggaagccatctctggcaatgatattctgaaaatgttggggaagtgcacctacgagaagaacgagtataaagcggcaaagaatacatactccgccgaacgctttgtatggctaaccaaactgaacaacctcagaatcgttgacgacggagtggagagggctctaaattcaagcgaacggaaacttctgatcgatgagccgtataaaaaggccaagttgacttacgcacaggtccgaaaaattctcgaactgcccgacagtgctgtgttcaagggcgtgcgctactttgccgataacgcggagtcttccacattaatggagatgaaattctggcacagcataagaaaggccctggaatcgaataacctaaaagacgagtggctcgtcctgaagaccaagcctgaacttttggatgagatcggtacggggttttctatttataaaactgacgatgacatcacctcctacctgtcaaataagctcgataaaaaggttctggacatacttctggtggaagtaagtttcgataaatttattgagttgagcctcaagtgtctgaggaagatcatcccattaatggagaaaggatatcggtacgacgaagcatataagtacatttatggcgaggtgaacatcgaatacaatctgaacgacattaaaaatcccgtcgtgctacgctccttctctcagagcagaaaggttataaacgctgtgatcaggctctacggcagtcctgcccgtattcatatcgagacagctcgggatatcgggaaatcattcaaggagcgaaaagccattgaaaagcaacaggagaagaatagactggaaaaagtcagggcagccgagcactttaagcagcttttcccaaactatgtgggagaacccaaagctaaggacatattgaaagtacgcctgtacgagcagcaacagggtaagtgcctctattccggcaagatcctggatattaaacggttaatggagcatgggtacgttgaaatcgaccacgcgctgccttttagcagaacttgggatgactctttcaataacaaggtgcttgtcttggcaaatgagaaccagaacaaaggaaataagaccccatatgaatggtttaacggcaaagataattcagacagttggaagaggttcctcgccctggtgaacaatagcggtttttccgctgtcaagaaacaacacattctaatgaaggagatcgatgaagaggggttcaaacagcgcaacctgaatgacacacgatacataacccggtttctctgtaactgggtggagaataacatcccgctgcttggcaagggagttaaacgtgtgttcgcaccccagggcaagattacggccttgctgagatctaattgggggatcaggaaggtacgcgaagataacgaccggcatcacgccattgatgctatcgtcgtggcctgcactacagtttcgatacagcaaagaattaccaattatgtgaaaaacagcgagatcaataggaagattaaacgacagaactacttaaagtttcctgaaccatggaaattctttcgcgaggacatctccatacgggtcttctcaaacaatcccatcgaggaactcaagcagcagctgagtgacagacctgaggcaaaccatcaattcgtgactccactttttgtatctagggcgcccgtgcgtaaaatgacaggacagggtcacgaagataccattcgcagcgctaagcggatctccgagggcatttcagttctgagagtcccgttgacgaagctcaatgacaaaagcctggaactaatggtgaacagggagcgagagaaggaactgtacgatgccctcaaacagcggctgcttgagttcaagaatgaccctgaaaaagcatttgccgagcccttctataagaagggaggacagcaagtgaaaaccgtccgcatcgaaagagttcagaagaacggcgtgttggtgaataacaatacaggtatagctgataacgggaatattgtaagggtcgacgtgtttctgaaaaagaaaaagtacttcttagttccaatctattcttggcaagtggccaagggcatcctccctaacaaagcaattgtcgctcataagaatgagtgtgattgggccgacatggatggatccgcgcagtttctgttcagtctttacactaacgacctgatcgaggtggttctaaaagatagcaccattctcggctatttttcttccatagaccgggccacagctgcaatcattatcaaggaacccgatatggagaaatcaaaggggaaggaagggattcaccgagtgggtgtaaaaactgccagaagtttcatcaagtacaatgtcgacgtgctgggcaaaaacataagccgctgcaggaaggctaaacgtttgccagtgcggtga

SEQ ID NO: 2610 - RNA, 3108 nt, synthetic construct
  misc_feature 1..3108: note = Cas9 variant
  source 1..3108: mol_type = other RNA
atgctgagaaagatgcactacaggctcgcccttgacctgggcagcacctccttggggtgggctatgatccggttaaacgcaggaaatgagccctgcgccgtgattaaagcgggtgtccgcatattctctaacggccgaaatcctaaggatgggtcaagtctggctgttacacgtagagaagccagggcaatgcggcgcagaagggaccggctactcaaacgcaaggcccgaatgatccagactctgattgagtatggatttttcccagctaaagaagatcaaagaaaggcacttgagatcatgaacccgtttgccctgagggctaagggcttgaatgaagccctcacgcccgcggagttcgcacgggccctgtttcatattaaccagcgtcgcggtttcaaaagcaatagaaagaccgacaaaaaggataacgactccggggctctgaaaacagccatcaataagctcagggagactttaaagaccgaaaactgtcggacagtgggagagtggctgaataaacgagatgtagcaggccttaccgtgcgcgctagataccaccaggacaagactataaaagaagatggcaagtctaaaatcaacaagtattacgacttgtatattgatagggccatgatcgagcatgagtttgacgaactgtggaaaaagcaggcggagctaaatcctacactcttcaccgaagccgcacgggctgatctgaaggacgtccttctgcaccaacgcgccttgaaaccagtgaagcccgggagatgcacgtttatgcctgacgaggaaagggctccactcgccctgccctcgactcagcgtttccggatgtaccaggaggttaacaatttacgaatactgagagatggactcaaagaggaatcacttaccctgaaccagagggacgatttgatcgcagccctagaggaaaacaataagcgcacatttactcaaattaaaaagctgctcggtctgggcggggtggtcaagttcaactttgaggaccctaaacgggaggaacttaagggaaataccacaagcgctattctgggcaaagatgagcatttcggtagtgtgtggttcaagtttgacgaagcgaaacaggatgcaatcgtaatgcagttgttcaaggaggaaaacgaggccaagctcctgagatggttacagaatgaaaccgggattgacgagaaaagggctgagacgatcgccaacgttggactgccagaaggctatggctccctatgtgcactcgccctggctcgcatccttccggagttgcgacgggatgtggtcccctactctgacgccgcaaaggcggctgggtttcaccacagcgatacttccaataaccaagaagtgcctggactgacattcccaattgagctcgtggtcaccgagactggtgaaataaaaacaaagcatatctttcacgagctgccctactatggcgaataccttcagcgtcatgttgggttcggatcaggcaaacctgaggacagtgccgaaaagagatatggtaagattgcaaatccaaccgtgcacatcgggctgaaccaggtaaggttggtggtcaatacgctcataaaacgctacggccaccccagcgaggtgattgttgaggtggcccgggacctgaagcaatctaaagatttaagagacgaagagggaaagaggcaggctgaaaaccagaaacgaaataagcgcatccggaccgccatcgcaggcgtcctgcagacatccgaggaaagagtgaggcgtgatgacattgagaaaatgatcctatgggaggaactctcatttgatccggctgaccgccggtgcccttatagcggggtacaaattagtgccgcgatgctgctttctgatgaggttgaaatagagcatatcttgcccttctcccagactctggacgatagcctcaacaataagaccgtggccctgagacaggctaacagggtcaagggaaaccgaacaccatgggaagcatttggtgcccagtcgactgctggcttcgactacgccaccattttagcacgggcggagcacatgcctaaagggaagcgctatagatttgccgaggatggataccaaaggtggctgaaagacgatgctggcttccttccccgggccttgaatgacacacgacatatgtctaaggtggcaagagaatacatgtccctcatctgtccaaacacccgcgtcatccccggtaggatgactgctatgctgcgtgggaaatttggcctaaatgacgtgctgggactcaacggcgagaagaatcggaacgatcacagacatcacgccgttgacgcatgcgtgattgccgtaacggatcaggggctgcttcagaggttcgctaaggcgtcagccagtgcacgcgaacagcaattgaatcgactggtcgagaacatgcctttaccatgggagagctatagagaacacgtggagcgggctatagacgccatctgggtttcccataaaccggatcactctcatgaaggagccatgcacaatgacacagcttacggtctcctgggcgatgggaaggtgagcattcacaaaatggtcgagggaaagagggaacgcatcgaggagtcacttaaagtgattgcattcaccaacgccaaggcgaatgaccgtcatggcctgttggataacggtgaacccagaccttataaggggtacaaaggcgacagtaattattgtatcgagataatccggaacgaaaagggaaaatgggagggcgaagtaatttccacttttgatgcttaccagctcgtgagggagcacggggttgcccgcctgcgacatccaaccctaagcgtctctggaaagcccctggtgatgagactcatgaaagacgagacaatccggatggtgaccaatgaaaagcctattactgcaagggtctgctgggttcgctcagatacaagaatcgccttcgctagtacgagcgaggcaaacgtggacgccagggaccgggataagaacgactccttttcttatatagtgaaaaccgcgtcggtactgcagaaacttcaggctcgtcgcattagcatctccccaactggcgaattgcgagatcccggtttcaaggagtga

SEQ ID NO: 2611 - RNA, 3108 nt, synthetic construct
  misc_feature 1..3108: note = Cas9 variant
  source 1..3108: mol_type = other RNA
atggagcagctgaactacatcctcggccttgacattgggatagccagcgtgggatgggctgtcgttgaaatcgatcacaatgaggaccccattagactgatcgatgtgggtgtaaggaccttcaacaaggcagaagtggccaaaacaggcgagtccttgtctttaattcggcgcctggcgcgagggtcacgtagactggtcaggcggaagaaaatgcgcctcctgactgctaagagacttctgaaaagtgaaggaatcttgagcgacctcgattttaataagggcgccatactgaacctgcctaataactgctgggagctcagggtgaagggtttagacaaaaagctgtccgataaagagtgggcagccgttcttttgcatatcattaagcaccgggggtatctgtctcagcgcaaacatgaccgaaagacggatgacaaggaactaggagctctcctgtcgggcgtgtcaaagaatcacagccttctggaggaaggcgagttcagaaccgcagccgagttggctatcaacgtcttttgtaatagtaaggggcatattaggaaccagtggggagattactcccacacattctctcggctcgacctgcagaaagaaatcaagcagttatttgtgagccaacgtgagctgggtaatccatatacttcctcaagtttcgaagagaacataattagcctccttatgaaacagaaggaagccatctctggcaatgatattctgaaaatgttggggaagtgcacctacgagaagaacgagtataaagcggcaaagaatacatactccgccgaacgctttgtatggctaaccaaactgaacaacctcagaatcgttgacgacggagtggagagggctctaaattcaagcgaacggaaacttctgatcgatgagccgtataaaaaggccaagttgacttacgcacaggtccgaaaaattctcgaactgcccgacagtgctgtgttcaagggcgtgcgctactttgccgataacgcggagtcttccacattaatggagatgaaattctggcacagcataagaaaggccctggaatcgaataacctaaaagacgagtggctcgtcctgaagaccaagcctgaacttttggatgagatcggtacggggttttctatttataaaactgacgatgacatcacctcctacctgtcaaataagctcgataaaaaggttctggacatacttctggtggaagtaagtttcgataaatttattgagttgagcctcaagtgtctgaggaagatcatcccattaatggagaaaggatatcggtacgacgaagcatataagtacatttatggcgaggtgaacatcgaatacaatctgaacgacattaaaaatcccgtcgtgctacgctccttctctcagagcagaaaggttataaacgctgtgatcaggctctacggctcacccgcccgtattcatatcgagacagctcgggatatcgggaaaagtttcaaggagcgaaaagccattgaaaagcaacaggagaagaatagactggaaaaagtcagggcagccgagcactttaagcagcttttcccaaactatgtgggagaacccaaagctaaggacatattgaaagtacgcctgtacgagcagcaacagggtaagtgcctctattccggcaagatcctggatattaaacggttaatggagcatgggtacgttgaaatcgaccacgcgctgccttttagcagaacttgggatgactctttcaataacaaggtgcttgtcttggcaaatgagaaccagaacaaaggaaataagaccccatatgaatggtttaacggcaaagataattcagacagttggaagaggttcctcgccctggtgaacaatagcggtttttccgctgtcaagaaacaacacattctaatgaaggagatcgatgaagaggggttcaaacagcgcaacctgaatgacacacgatacataacccggtttctctgtaactgggtggagaataacatcccgctgcttggcaagggagttaaacgtgtgttcgcccctcagggcaagattacggcattgctgagatctaattgggggatcaggaaggtacgcgaagataacgaccggcatcacgccattgatgctatcgtcgtggcctgcactacagtttcgatacagcaaagaattaccaattatgtgaaaaacagcgagatcaataggaagattaaacgacagaactacttaaagtttcctgaaccatggaaattctttcgcgaggacatctccatacgggtcttctcaaacaatcccatcgaggaactcaagcagcagctgagtgacagacctgaggcaaaccatcaattcgtgactccactttttgtatctagggcgcccgtgcgtaaaatgacaggacagggtcacgaagataccattcgcagcgctaagcggatctccgagggcatttcagttctgagagtcccgttgacgaagctcaatgacaaaagcctggaactaatggtgaacagggagcgagagaaggaactgtacgatgccctcaaacagcggctgcttgagttcaagaatgaccctgaaaaagcatttgccgagcccttctataagaaagggggacagcaagtgaagaccgtccgcatcgaaagagttcagaagaacggcgtgttggtgaataacaatacaggtatagctgataacgggaatattgtaagggtcgacgtgtttctgaaaaagaaaaagtacttcttagttccaatctattcttggcaagtggccaagggcatcctccctaacaaagcaattgtcgctcataagaatgagtgtgattgggccgacatggatggatccgcgcagtttctgttcagtctttacactaacgacctgatcgaggtggttctaaaagatagcaccattctcggctatttttcttccatagaccgggccacagctgcactgatcattaaggaacccgatatggagaaatcaaaggggaaggaaggaatccaccgagtgggtgtaaaaactgccagaagtttcattaagtacaatgtcgacgtgttgggcaaaaacatcagccgctgcaggaaggctaaacgtctgccagtgcggtga

SEQ ID NO: 2612 - RNA, 3111 nt, synthetic construct
  misc_feature 1..3111: note = Cas9 variant
  source 1..3111: mol_type = other RNA
atgagaatcttcggctttgacattgggataaccagcatcggatgggcctacgtggagtccaacgaactgaaggattgcggtgtcaggattttcacaaaagctgagaatcccaagaacggcaaatctctcgcacttcctcggcgcgaagcccgaggggcgcgtagaaggctggctcggcgcaaggccagattgaatgcaatcaaaaggttactgtgtaaggagtttggactaaacgtttcagactatttcgccaatgatggcgaactcccaaaggcttacgagactacgaaagacaccaagagtccgtatgagctgcggagccttgcactggaacagaaattggagcccaaggaactcgcccgcgtgattctgcacatcgctaaacatcgaggttacgggaacaagcacgccaagacaggatccgataaagactctggcaaggtactgtcggcgataaaagtgaatgagactgcaatgaaggataaatatcaatcagtcggcgagtacctctataaggaattttaccagaaattaagactggagagcgaaaagaaggggaacaatatcaccaaagagttcaagaacgtgaggaataaaggagaaaactacgagcattgcgttgcccaggaacaggtgcgggctgaacttgagttgatttttgccaagcaaaaagacttcggtgcaacatttagtgaaaatttcgagtcccagatcattgaaaccgctttttatcagcgtgatctgaagtctttcgaggacaaggtcggcaaatgtgtgttttacgagaacgaaaatcgcgcccctaaggatagcctatccgcgatggagttcgtagccctcactagaatcataaacacactgaaaaaccttgaagagaagtcaaagaatctggggattggagaagtttatggcaaggacaagatccaggagattttgaaaatcgtgctcgataagggtgagatgagttacaaaaagctgagggaaatcttacacctggacgagcatattctcttcgcaaaagacagcaaacttgattatacccaaggggtccaggaagctgagaaggccaaatttatagagctgaagaacttgaaggctttcaagaaagccatgggaggcgacttttctaatttcgcacgggaggagctagataagatcgccacggacattactctggtgaaatccaaggaaaacctcgctaagaaactgcagaattactcagcgcttagcaaggaacaggtggaagcactgagtaacttgtcttttgccaaacacatcgatctctccctgaaggctttagagcaaatactgccattcatgcgaggcgacaaaaccgggaagtgcctacgctatgatgaggccgtcaagaaagcagaactccaggagcacagaaagcataaacagaagggagaatttctgattccccttaaagactacgagccttacttggccaatccagttgtggctagggccctgagcgaatatcggaaggtactcaacgcactgcttcgcaagtacggtaaagtgcacaagatccatctggagttcacaagagaggcgaaattgtcggctaaggaaaggcaaaaatatgagaaggaacagaaggagcactttgaagccaatcagcgtgcaatccagcaatgtgagattctcggcctgcccatcaacgggactaatattttaaaaatgaagctgtggctagagcagggagaatgctgtgcctactctggcgagaaaataacccgggaacacctcctggattccaacgcccttcaggtcgaccatatctatccttactcacgaagtttcgatgacagctatatgaataaggtgttggtttttgctaaagagaaccaggacaagggtaataaaacaccattcgaggcatttgggggcgataaggaaaagtgggacaggattctgtccctctctgctaaactgccgaagcaaaaacagagacgcatcagcaacaccaacttcaaggataaagagggaggcttcttagcccggaatctgaacgacacggggtacatcgcgaaacttgcctcacagtggactaaggattgcttggaatttgaggacctcagagaaaatgaggtgacaattgctggagagaaaggtagttccgtccacatagaagtggtaagcggccagctgacctctatgctaaggcattactgggggctgggaaacaaggatcgcaataaccacctccatcacgcagttgacgccgtgatcctggcttatactaataacgccatgattaaagcattcgcgaattttcgaaagaaccaagaggaaaataaaaagaagttctacgccaaacagatcgctgagtcagaatataaggccaaaaaggcatttttcgagccctgtaaaaactttcggcagcgtgtcgaggaaaagattaaggagatcttcgtgagtaaacctccaagaaagagggtccgcggcgcccttcaccaggaaacattttaccccttcgagaaattgtgcaatgataaggaatatagcgagaaactgaagatggactacggtggggagaagggcatgcaaaaagctatagcattaggaaagatccggcagattggcaccaaaatcgtgtccaacggggccatggttagagtggatatttttaaggacaaaaagggaaaattctatgctgtacctatctacacgatggattttgcgctcggtatactgccaaataaggccgtcgcaattggcaaggacaaagacggggtgatcaaggattggattgaaatggactctaactacgatttctgtttctcgctttttaaagacgatctgatcttggttcagaagaaagagatggaaagggctgagctctgctatttcgtgagctttggatccaccaacgcccaaataaatgtcgagaagcataacaataagttcgaaggcctgtcagagaacgagaaaatcctatacagtaatgccacacagaaggaggtggctggtaaatctattgggatccagaacctgaagacttttgaaaaatatcaggtaagccccctcggcgaggtgcaaaaggcagagttcgaaccgcaccaggagattaagctgaaatcctcacctaagcgaaaagactga

SEQ ID NO: 2613 - RNA, 3111 nt, synthetic construct
  misc_feature 1..3111: note = Cas9 variant
  source 1..3111: mol_type = other RNA
atgctgcacaagatgcattacagactcgcccttgacctgggcagcacctccttggggtgggctatgatcaggttagatgcagacaaccagccctgcgccgtgattaaagcgggagtccggatattctctaatggtcgcaaccctaaggatggctcaagtctggctgttacacgacgtgaggccagagcaatgaggcggcgcagagacaggctactcaaacggaaggcccgcatgatgcgaactctgatcgaatatgggtttttcccagctgaggcagcccaaagaaaagctcttgaaacgattaatccgtttgccctgagggcgaagggattggatgaggcactcacccccgccgagttcggccgggctctgtttcacatcaaccagcgtcgcggtttcaagagcaatagaaaaacagacaagaaagataacgactccggggccctgaagactgcaattggaaaagtgagggctaccatcgaagccgagggctgtcggacagtaggcgaatggctccataagcgagatgtggcggggttaaccgtccgcgccagataccaccaggacaaggtgataaaagaggatggaaagactaaaatcgacaagtattacgatctgtatattgacagggcaatgatcgaacaggagtttgacgagctttggaaaaagcaagctgaattgaatcctgccctgttcacagaggctgcccgggcagatctaaaagacgttctcctgcatcagcgcccacttaagcccgtgaagtctggtagatgcacctttatgcctgatgaagagagggccccactggctttgccctcgacgcagcgtttccggatgtaccaggaagtcaacaatctccgaatcctgagagacggcttaaaagaggagcctctgactctcaagcaaagggatgaccttattgcggcactggagaaaaactcaaagcacagctttacccagataaaaacattgctaggggtgggaggcgccgtacagttcaattttgaagatctgaagcgccaggaactcaagggtaacactaccagtgctattctgtccaatgacaaacacttcgggaaggcctggttcacatttgatgaggcaaaacaagacgccatcgttcttcagctggtgaaggaagagaacgaggctaaattggtccggtggctccaggatgaaaccggaattgacgagaagagagccgaagcaatcgcgaatgtgggcctgccagagggctatgggtctttatgtgctaaggccctggcaaggatcctaccggaactccgccgagacgtgatgacgtacgataaagccgtccaagctgccggattcgagcatcacagccggctgggttccaacactgagattcccggccttacatttaagatagaatcaatcgaccaggatagtggggaggttaaacagttccatattcacaaggtgttgccttactatggagaatacctgcagcgtcacgtaggctttggtagcggggagccagaggaccccgcagagaaaagatatggcaagatcgctaaccctaccgtgcatataggactcaatcaaattaggctggtcgtgaacgcccttctgaagcgctacggccacccatctgaagttatcgtggaattggcgcgggatctcaaacagtccaaggaccagagagatgaggaatcaaaaaggcaggccgagaatcaaaagcgaaacaaacgcctgcgggacgctatcgcagggactttaaagattagcgaggaaagagtcaggcgtgatgacatccagaaaatgattctgtgggaggaactaagtttcgatcccgccgaccgccggtgcccgtattctggagctcagatatccgccacaatgctcctgagcgatgaggtggaagtagagcatatccttcctttttcgcagaccttggacgactctctgaataacaagacggttgcactcagacaagcgaataggattaagggtaaccgaaccccctgggatgccttcggcgctcaggccgtggcagggtttgactacgagtccatcctggtccgggctgaaggaatgccaaaagccaagcgctatagattcgcagagaatggctaccagaggtggttaaaagatgacgcctcatttctggctcgggcgcttaacgatacacgacacatgagtaaggtggccttcgaatacttgaaactcatctgtcctaatactagagtcattcccggtcgcatgaccgcaatgctgagggctaagtttgggctaaacgacgtgctgggcctcaatggagagaagaaccgtaatgatcatcggcaccacgccgttgacgcctgcgtgatagctgtaacagatcagggcctgcttcaaagattcgcaaaagccagcgcgtccgctagggaacagcagttgaaccgcctggtcgagaacatgccattaccctgggggtcttatcgagagcatgtgcaaagagccatcaatgcaatttggatcagccacaagcctgaccattcacacgaaggagccatgcacaacgatactgcttacggtctccggggcgacgggaaagttagtttccataagatggtggagggagtcaggacccactccgaagataatctgaaagtgattgagatcagcaacgcaaaggccacagaccgccatggccttctgccaaatggtgagccgcgtccctataaggggtacaaaggcgactctaactattgtatagaaatcgtaagaaatgagaagggaaaatgggaaggcgaggtgatttcaacctttgaagcgtaccagttggttcgggagcacgggatcgctaggctccgccatagtactctgagcgtctccggaaagctactggtgatgcgactcatgattgatgacgtggtcagactgatcatagatgagcagacgcggacaatgaggattgccaccctttctggcaacggtcagatcttcatggcagacacttcggaagccaatgttgatgctcgcaacagaagcaaagaggaaacctttgcctatgtgtccaagatggcagggtcattgcaaaaggctaatgccaggcggattaacatcagtcctataggagagctgcgtgacccaggcttcaaagaatga

SEQ ID NO: 2614 - RNA, 3114 nt, synthetic construct
  misc_feature 1..3114: note = Cas9 variant
  source 1..3114: mol_type = other RNA
atggagagaatcttcggctttgacattgggaccacaagcataggattctccgtgatcgattactcttcaactcagagtgccggtaacattcaaaggctgggcgtccggatctttcccgaagctcgcgaccctgatgggacgccactcaatcagcagcgacgtcagaagagaatgatgaggcggcaacttcgcagaaggcggattcgccgaaaagcactgaacgagaccttgcacgaagccggattcttaccggcgtatggcagcgctgactggcccgttgtgatggccgatgagccttacgaactgagaaggcggggtctagaggaggggctctccgcatatgaatttggacgtgccatctaccatctggctcagcaccgccatttcaagggcagagagcttgaagagtctgacacaccagatcccgacgtagatgacgagaaagaagcagccaatgagagggctgccactctgaaggcgttgaaaaacgaacagaccacactcggcgcatggctggcccggcgacctccatcggatcgcaagagagggatacacgctcataggaatgtggtcgccgaggaatttgagcggctgtgggaggtgcagtcaaagttccaccccgcactcaaaagcgaagagatgcgcgctagaatcagtgacaccatttttgcccaaaggcctgttttctggcgtaagaacactttaggagaatgccggtttatgccaggtgagccgctgtgtcccaaaggctcctggctttctcagcagcgaagaatgttggaaaagctgaataacctagcgatcgccgggggaaatgcaaggcctctcgatgctgaggagcgcgacgccattctgagcaaacttcagcaacaggcttccatgtcatggccaggcgtgcggagtgccctgaaggcattgtataagcagagaggtgaacccggggccgagaaaagcctcaagttcaacctggaattaggaggcgagtctaaactgctcggcaatgctcttgaagcgaagctggcagacatgtttgggcctgattggccagcccaccccaggaaacaagagatccgccatgctgtccacgagcgattgtgggccgcagactacggagaaacaccggataagaaacgggtgataattctatccgagaaggaccgtaaggcccatagagaagctgccgcaaactcattcgtagcggatttcggtatcaccggcgagcaggctgcccagctgcaggcactcaaactgcctacggggtgggagccctatagcattccagcccttaatctgtttttggctgaactcgagaagggagaaaggttcggcgccctggttaacggtcctgactgggaggggtggcgccggactaattttccccacagaaaccaaccaaccggcgaaatcttagataaactgcccagtcctgcatctaaggaggagagggaacgaatctcccagctacgcaacccaacagtggtccggactcagaatgagctcagaaaagtggtgaacaatctgattggactttacggcaagccggacaggatacgtatcgaagtcgggcgcgatgttggaaagagcaaacgggagagagaagagattcagtcgggtatcaggcgaaacgagaagcaacggaaaaaggctaccgaagacttgattaaaaatggcatagccaacccctctcgcgatgacgtggagaagtggatcctgtggaaggaagggcaggagagatgcccttacacaggagaccagatcggcttcaatgcgctctttagggaaggtcggtatgaggtagagcacatttggccacgatccagatcattcgataacagtccccgcaataaaaccctgtgtaggaaggacgtgaacatcgaaaaagggaatcgtatgccttttgaggccttcggccatgatgaagaccggtggagcgctattcagataagacttcaaggaatggtctccgcaaagggcgggacgggaatgtctccaggtaaagtgaagaggtttctggccaagactatgcccgaggatttcgctgcccgccagttgaacgacacacgatacgcagcgaaacagatcctcgcccagctgaagagattatggccggatatgggccctgaggctccagttaaagtggaagccgtcaccgggcaagtgactgcacagctgcggaagctatggacactcaataacattctggctgacgatggagagaaaaccagggccgaccaccgccatcacgcaatcgatgcccttacggtagcttgcacccatcccggcatgacaaataagttgagccgttattggcagctgagagacgatcctcgggcggaaaaacccgccctcactccaccttgggacaccatcagggcagacgctgagaaggccgtttcagaaattgtggtcagtcaccgcgtgcgaaagaaagtctccggtcccctgcacaaggagacaacttacggggataccggcacagacataaaaaccaagagcggaacttatagacaatttgtgacgcggaaaaagatcgagtctttatcaaagggcgaactggatgagattagggacccacgcatcaaagaaattgttgccgctcatgtggcagggagaggaggcgatccgaagaaagccttccctccctacccatgtgtaagtcccggtgggcctgagatcaggaaggtccggcttacaagcaaacagcagttgaacctcatggcgcagaccggaaacggctatgctgacctgggttccaatcaccatatagccatctaccgtctaccagatggcaaggcagactttgaaattgtgtctctgttcgatgcctcgcgccgactcgctcaaagaaaccccatcgttcagaggactcgggcagacggggccagcttcgtgatgtccctggcggctggagaggccattatgatccctgagggctcaaagaaagggatatggattgtccagggagtgtgggcaagtggccaggtagtgcttgaacgcgataccgacgccgatcactctacaaccactagaccgatgccaaatcccatcttgaaggacgacgctaaaaaggttagcattgatcctatcggtagggtccggccatccaacgactga

SEQ ID NO: 2615 - RNA, 3117 nt, synthetic construct
  misc_feature 1..3117: note = Cas9 variant
  source 1..3117: mol_type = other RNA
atggccaaacaggtgagatacaggctgagcctcgaccttggctccacctctctggggtgggctatcttccggttggatgcagacgcccaccccacagcgattataaaggctggagtccgcatcttttcagatggtcgaaacgccaaggacggcagtagcttagcagttactcgtagagccgctaggtccatgcggcgcagaagggatcggctgctacgccgaaaaacgagaatgctcgacgcactgcttgagtatgggttctttcctcaagatgccgctcagaggaaggccctggaacggttgaatccatacgcgctccgtgcagagggactggcccgcccgctgacccccggcgagttcgctagagccatttttcatctcaaccagaggcggggtttcaaatctaatcgaaagacagacaagaacgataatgactcgggggcattaaaaactgctacctcacagctgcgccaagatatccaggccagcggatgcagaacagtgggcgagtggctttggacccagaggttgcagaagaaacctgaaggcgtaccacaccaaggggtgcgggcgcgctatagagagactccccatattaacagtgagggaaagaaaaggatcgaaaagaagtacgacctgtatatagatcgttccatgatcgaggccgaatttgacgcactatggtctgctcaggccacattcaatcctgtcgtgtttcacgctaccgcccatgagaaactcaaggacattctgctttaccagcggccactgcgacccgttaaacctggtagatgtacgttgctcccagaggaagagagggcaccgctggccttacccagcactcagcgcttccggatctatcaagaactgaacaatctcagacttctggtggatcagttgaacgagcagcctctaaccctggctcaaagggacacaattgcgactctcatggaaggccgcgcaaagatctcctttgatcagatacgaaaagccctgaagttagggtcaatgaccaaattcaatctggaggacgataagcggaacgagttgaagggaaatgctacaggcagtcagctcgccaaaaaggaatttttcggtccagcatggcaccagttcgacgaggccctgcaagatgacattgtctggcacttactgagcgaagagaacgaatctgctctaatctcctggctccaggatcgtaccgggattgacgccgcaacggcgcaggctgtgtcaaatgccagcctgcccgagggatacggcagtctttctagaaaagcattggaggtaatcctgcctaggctccgctccgaagttatcacttacgataaggccgtgcaggctgccggctttagccatcactcgcaactggggttcgagtatgacccagacgatgtcgaagactggattgatcatgcaacaggagaggtgaaacccatatttaagcggcttccgtactatggtaaggctctgcagagacacgtggccttcggctctgggaaacctgaagactcccaggagaagaggtacggaaaaatcgcgaaccccaccgtccacattggcttgaaccaggttcgagtggtagccaatgctctcatcgcacgctatggtcggccaactgagataattatcgaactggccagagatttaaagcaatcaagggagcagcgtcagcaggaccaacgccggcaggctgataaccagaaaagaaatgccaggatccgaaacagtattgcacaagcgctggggatcgccgaagctcgggtgcgcagagaggacattcagaagtggatactatgggaggaactcgatcctggcgacgccatgcataggtgctgtccctacagcggagtcccaatctccgcatctatgctgcttagcgaacaggtggaaattgagcacatcttgcccttttcaatgacactggatgacagtctcaataaccggaccgtttccctgcgacaggctaatagaatcaagcgcaacaggagcccttgggatgcccgtgaagacttcgaggcacaaggctggcattatgacgggattttacagcgggccggactgatgccagtgcagaaaagatacaggtttgctgcggatggttaccagcgctggcttcgagacgatcaagacttcttggccagagcactcaatgatacgcggtatctgtctaggatagctgccgagtacctacgcctggtctgcccgcagggcacccgtgtgatccccgggcagctcacagccctgcttagacggaggtttggattgaacgacattctgggcttagaaggtgagaagaatcgcaacgatcaccgacatcacgctgtagacgcatgtgttatcgggattactgatcacggcctcatgcagagattcgcccgggcgtcagctcaagccagggaacagggactgacccgccttgcagaggaaatgcctctgccatggcccacatatagagaccatgtggatagggccgtcagtttgatctgggtgagccacaaacctgaccatggccacgagggggctatgatggaggaaactgcatacggactcatgaaggatggtaccatacggcagcgtcacaaagccgacggcacaaaggggcgcgaggtcgcgaatgtgatccgaattgctgaaccagcccaacccaccagacatggagttgacgatcagggcaggccgctgccttataagggttacatcgggggctccaactattgcattgagatcactcggggagcacagggcaaatgggaagggacggtgatatctacatcggacgcctacggaattgtacgcgctagaggcatcgccggtctaaggaataccagccaggggcaaaacggacacccactggtcatgcggctcgtgattggcgattccctgcgacttagaatcaacgacgcattgcagactatgcgcgttaccaagatatcaggtaatggccaggtgtttatggctggggtccatgaggccaacgtggatgcgaggaatcgggacaaaagtcaggccttcgcactggtatctaagatggctggaagccttcaagccgctcaggcacgtcaggccacaatctcccccattggcgagatcagagatcctgggtttcccggatga

SEQ ID NO: 2616 - RNA, 3120 nt, synthetic construct
  misc_feature 1..3120: note = Cas9 variant
  source 1..3120: mol_type = other RNA
atgaagaaaagaatcctgggcctcgacattgggatagccagcgtgggatgggctcttatcgagttcgatgacgaatttcaggataacaagaaaaagggtaccattatcaaatccggcgtcaggattttcacacgggcagagactcccaaggaacgcgagcctctggccaagccacgacgtgaagcgagatctcaaaggcggcgcatctcatgcagagttgagaggttgaattttgtgcgggagttattcgtgaaaaacgggctggtagctaaggaaagtgtcaataaaaacaatccgaacaatatatacatcacgctaaaccagattaagaccccctggcagctccgcatggaggccctggaccgaaaacttacaaatgaagagtttgcagtggttctgactcacttggccaagcatagaggatataagagcctcaggaaaaccgattccaaggacaacaaaacaggcgagatgctgaaggctatcaatcagaacaaagaacggctggataattctgactaccgtaccctcggtgagatgttctgtaagcacgaatcgtataaagagcataagcgcaacaaggatggggaatacattaattcagtgactagagagttaatcgaggaagaggcagagaaaatatttgccaagcaaaggaaagaaggaaacaacttcgctgacgtcgatattgaacgggagtatctgaagatcgcctttagccagaaacctacaggcagtattaataagatggtgggcttctgcacctttgagaacggggaaaagcgagcgccacgcgactcctactctgcagagcttttcaaagtattgaatacgatcaacaatactaccatcacagatatgaagactggagaaaccagaaactttacaggtgccgagattaaaaagataatcgaaattatcaaagacaccaagggcataacgtatgttaagattaaaaaggagctgaaactagggagctcccagttctcaggagtggactacagggagaatgctaagagtaaaggcgaaggtgagatcttcgtcagcatgaagacttaccacgaaatcaagtctaaaattgagaagctctccaaagagaagtggaacaaactgaaggaaaatacagagcttctggattcaatcgtgaacattatagccaattttaaagacgatgaaagcatcaagaaggagttccagaaattgaagattgacgaagatatcatcgacgtgctcctgaactttgagttcaaaaagtttattaatttaagtttcaaagcactgcggaagataatcccctttcaattccaggggcagaagtatattaccgcttctatgtccgtcggatacagcctcaaacaggagggcatcaagaacaaatttcttcgcgttccttcgcaagaagagaatgtgaacgtaccagtggtcgccagagcgttcgcccagactaggaaggtgattaacgcagttatccgtgaatatggccagtttgatcaaataaatatcgagctggctacagacttgaaaaactctaagttcgatcggtccaagattgaaaaagggcagaaggagtttcagtcacagaaagacaaggtgttccaagaggtccaggatctaaccggagaaatcattcccagtagctccctgctcctgaaataccgactttggagagagcaggacgaaaggtgtatctattctggtcgcaagataagccggaaggacctgttggatacgggcttcctcgacattgatcatatcattccttactcaaaaagtatggacgatgggtttaataacaaggtgctgtgcttagccgaggaaaatagaaacaaaaagaatgacatcccattcaactattaccagaggataggacgcgattggaattttctgatctccattatcgctagcatgaaaaacatgaagtacgttaaaaagaagcgactactcaaacaagagctgtctgacattgagatcgaatcattcatagagcggaatattaacgatacccgttatgccacaagatacatcaagaattttcttgaaaacaatttggagttcaaagagaacgaatttatcaaggcaaaagtacaggccaggcacggcggtctgaccagtgtgctccgctataactgggggattagcaagaatcgggaggaatcctacctgcaccatgctaaggacgcgatcactgtcgcatgttctacacagggcatggtgcagtatatttcgaacataagccaaaaatacgagaatggaaagtataaaatgaagcagatcaaagaaagaactgagaacaggattccgaagccctgggattccttcaaggacgatgtcgagcgatcaatcaatgacatttttgtgagtttcgcccctcgccacaaagttaccggctctgctcataaggaaacaatctacagcaaaaagcaccttgagaaagggtacgtgaccataaagaagtccctggacaaaatcaagttgtcagatctcaaaaacattccatgcgacgaaaattgtgatatcattcgggtactgaaggagagattagaaaaatttaacgacgatagcctgaaggccttcgcagaccccgtccacatgcctactaagtgctctaataaaaagggaccaatcataaggtccgtgaaaattaaggagaacaataaaacgggtatcgaggttcgtaagggcctagtggaacgcggggatatggtccgggtggacgtatttatcaaagataagaagtattacctcgtgcccatttatgttagtgacttcaaaaacaaggatctgccgaataaagccatagtcagctctaagtccgagaacgaatggatcatgattgacaaaacatactcattcaagtttagtcttttcaaggatgacttgatcaaaattaagaataaaaagggagagatctttggctatctgggtggggtgcatagactcaccggcggaataaacatcaaaagctgttacaagcctaaggaaaaagacggcaacattgggtcgaagtgcctgttagatttcaggaaatttcaggtgggaatcctgggtgactataatgaggtcaagcacgagaaacgaatgcccgcttacattaacactaagaaggataaagaacattga

SEQ ID NO: 2617 - RNA, 3123 nt, synthetic construct
  misc_feature 1..3123: note = Cas9 variant
  source 1..3123: mol_type = other RNA
atggacagaagggatgcccgggctatgcgccgacgtagagacaggttccagcaacggcagcgcgcactgctcaagtaccttgtggccgatggcctgtttcccgaggacgaaggggagagaaaagcgttggctgccttagatccttatgcactgagggcccgggctctagacgaagcactcagcctgcacgagcttggacgcgccctgttccatttgaaccagcgaagaggttttaagtccaataggaaagctgatcggaaggccgacgatgacgcgggcaaaatcgcaattggggtcgatcgtgcccgcgaagctatggccgagaacggagcaagaacctacggcgagtggctccacaggcggcgagcttctgccacagacgcgaatgccataccaccggttcgcactagactgaggcccgaatcaggtgaggatgcaaagggggacggatatgacttctaccctggccgggatctgctcgaagaggagtttgctgccatctgggaagctcaggccgcacatcacccagacgtgttaacggatgacgtatatgagcgcctgttcgaaattgtgttttaccaaagaccccttaaggcccctcagatcggcatgtgcaccttgattgctggggataggcgtctgccaaaagcgcatcccctattccagcggcgaagactcctggaggaacttaacgcactgatgatcgtcaggcctggagaggtggcccagcgcttgacacgggaggaaagagacactctctttctgaagttaaaagataggaataaggttagtttcgagagcctgcgcaaaaccctcaagctagacccagatgctcgatttaacaaggaatccgagaatcggacagaactgaaaggtgacgaggtggccgcagccatgggctctaagacccgtttcgggaacagatgggtccacttgtcgatagaggaacaatgggctgtgatcgagaggctaggagatgtagaatcagacgccgaggacgcagcgtttcgcgcttggctggccgaacggtatgagctcactccggagcagacaagagcagttaccaatgctcccctgcctcagggctacggtaggttcggggaaacggctactcgaaaacttattgatgccctgcgcgacggagagaaggatggccgggtgttggtctacagcgaagcagtgaccgctgccggcctcgggcaccatagtgacagaaggacaggagaggtgttcgaggatgaagagggtcgtccacagctgccctattacggcgtcgcgttagaacgccacatcatgcctgggactggagacccatccgattctgacgagatgcgggttggcagactgaccaaccccacagtgcatattggtctaaatcaactcaggcgaatcgtaaaccggctgatacgcgcctatgggccgcctgctgaaattgcaatcgagcttgccagagagttgaaactgaccgatgaagacaagaaaaggattaataaggagaacaatagcaaccggctcgatgctgaacgaagatccgagaagctgcttgccatcggcaaacccgacacgggagcaaaccgcgcgctgttgaagctctgggaggaactgaatccagccaacgtgttagataggcgttgtatctactcaggcgtccagattagtatagacatgctgtttagcgctgccgtggaggttgaccacatcctacctttcactgcaacactcgatgactctaatgggaacaaaattgtgtgcacccgggaagctaatagagagaagaggaaacgctccccctatgaagcctggggacactcagcacgatgggaggaaatcgccgctagagcggcccagctgccacggaacaagaggtggcgctttgagcccgatgcaatggagaagttcaaagacgatggtggctttcaagctcgtcatcttatagacactcagtacttggccagactgagccgggaatatctcgccacactgtaccctgataagggggagggaagtggccacatttgggtctctccaggtaggttaaccgaaatggtgcgccgaaaactggggcttaatgacttgctcccggatcataacttcggcggaggcgctgaccaggcaaagaatagactggatcaccggcatcacgccatcgacgcggtagttgtggctatcgtcgatagggggatgctaaaccgcattgccagagcatccggacaggagggtgccgagggcagggaacggatcattatacccgagccttgggaagggtttcgtgacgacctgcgcacggctgtgaatgcaatcaccgtcagccaccgaacagatcatggaactgcctcgaaagcgggcctcccaaagggtaaggacgctaccgccgggagactgcacaacgatacagcatacggcttcactggagagtctgacgccaaaggcaattccattgtggttaggcgggtgcccctttcaagttttaagaaattggctgatatcgaccgcgtaagagatcctgaactgaaggccgcattatatcaacatctcgacgggctggagggaaaagccttcgagaaggccatcggcgaatttggtagcagggagtggcacccatacgggggagtccggcgagtgagagttaccgaacccctttccgtgattccgatacgcgataggaacggccacatctataagggttacaaaggcgactctaattatcggtacgatgtctgggagctgcctgggggaaagtgggtgaacgaagtagtgagcatgttcgacgcgcatcagccaggctggcagtcagccattcgtgcagctaaccccacagccagaaaagttttgagtctccacagggacgatgtcctggctatcgagcgcaatggggcagagcgggaacttgtgcgagtggtcaagttttccgagaaacagttcgccgttgcccctcccaacgaaggaggcgctctgaaggcgagagacgcagataaaggtgacccattcaagtatagctacccttctcccaataccctcaaggccctgagggctcgccaagtgcggattgatgagcttgggagagtgttggacccaggatttccggcccgtactaaacagaggaagacgcggaaacctaactga

SEQ ID NO: 2618 - RNA, 3132 nt, synthetic construct
  misc_feature 1..3132: note = Cas9 variant
  source 1..3132: mol_type = other RNA
atgcagagagacaaccccctggtgtacaggctcgcccttgatctgggcagcacctccttggggtgggctgtcttccggttagacgcagagggatctcctctggccatcattaaggcgggtgctcgcatattttcagatggccgaaatccaaaagacgggagtagcctagccgttacacgtagagcagccagggctatgcggcgcagaagggatcggctcctgaagcgcaaagcacgaatgcttggagccctggaaagacacggcttctttccgcaagacgagtccgctaggaaggtgttggaaactctcaaccccttcctgctgcgggcccagggtctcgaggtagcgttaaaacctgaagagtttgggcgtgcactgttccatcttaatcagcgcagaggatttcagtctaacaggaagacggatcggaaggactcggattcaggcgccttgaaacaagctatcggcaccctgcgagcccagatgcacgagagcgggtgccgcacagtgggagaatggttctggaaggtcagaatggagcataaaccagaaggtgtgaagggccagggggttagggcacggtatcgcgagactccctttaccacagacgaggggaaaaagagaattgataagaggtacgacctatatgtggatcgtgctatggtcgcccaggagttcgacgcgctctgggccgcacaagctgcctttaatcctgctctgttcaacgaagccgcacgggccgaacttcgagacatcctgttgcaccagagaaaactcaggccagtgcagcccggccgctgtaccctggtacctgaggaaccacgggctttactggcgctcagttccactcagagatttaggatttaccaagaggttaatcatcttcgcgtgctgcacgatgagttgcgagaagagacactaaccctggcacagcgggaccagatcgtcgccctcctggaaaagcaagctaaagtgacgttcactgccatgcgtaaggcacttggtttctctgccctgtttaacttggaggatgctaaaagagacgggctcaagggaaatgccaccgcagcggctctgagcaaaaaggatttattcggcccgctgtgggccggctttgggacagcactacaggacgaaatagtgactcagctcatgaccgaggagtccgaacccaggctgatcgcctggcttcaggagcacacaggagtcgatgaagctcgcgcccaagcaattgctaacaccggtttgcctgagggctatgggtcactgggacggacggccctcgcgagaatcgttccagaactgcagagggacgtgattacttacgataaggccgtacaggctgcaggcttcgcccatcacagtgaccttggttttagcttcgagcatggggctgatgaggtggaacgaatcggcgagcgcacaatagcctctaccggagaaattaaacccgtctttgcattcaagcagctgccttattacggccgggcgttgcaaagacacgtggcctttgctaaagacaatccaaggaacgacgaggagcgttacgggaagatcgccaatcccactgttcacattggactcaaccaggtgcgcgtcgtggtaaatgcactgatgcggagatatggtaggccggctgaagttgtgatcgagttagcccgagatctgaaacagtcccgggaacagaagctagaggcacaacagcgccaggccgacaaccagaagagaaacgctaggatccggcgatcaattgcggaagtcctcggcataagcgaggagagagtgcgcacactggatatccaaaaatggattctttgggaagagttgagtcatgacgccgcagataggcgttgcccttactctggggtccagatctccgctagcatgctgctcggagaacgggtggagatagaacacattctgcccttctcgatgaccttagacgattctctgaataacagaacggttgcccttagggaggccaatcgcatcaagcgaaacagagctccatgggaggcacgggccgactttgaagcgcagggctggtcctatgatggtatcttgcaaagggctgagcgcatgcctctccgtaaaagataccggttcgcccccgacgggtatgaaaggtggctgggcgaggataaggactttctagcacgcgccctgaatgatacccgatacctctcaagagtggctgcagaatatctgcggcttgtatgtccaggaagtgccacaagggtcattcccggccagatgactgcgttgctgcgcgggaaattcggattaaacgacgtgctcggtctggacggcgagaagaatagaaacgatcataggcaccatgctgttgacgcctgcgtgatcggggtcaccgatcagcggatgatgcagcgtttcgcacaagccaatgctcaggcccgcgaggacggacttacacgactggtggaagatatgcctttgccatggccgacttacagagaccacgtagagagggcagtgcaccatatttgggttagccacaagcccgatcatggctttgaaggtgctatgatggaggagacctcctacgggatactccgggacggctctatcaaacagcgcagaaaggccgatggaagcgcgggcagggaaatttcaaacctgatccggatcgccgagcctgggcagccacaacgacacggagtcgacgcagaaggcagacccctaccttataaaggttacgtgggaggaagtaattattgtattgagataacagtgaacgataagggcaaatgggaaggtcaggtcatctccaccttcgacgcttaccgcattgttagggagggcgggctgcggcagctccgtcacccaactcagggacaaaatggcagagccctggctatgaggcttgtgatcggggatagcgtgcgcttggaggcaggagaaggctctctgcagacgttacgggtagccaagatgtcagccgctggtcaggtctttatgagtgaggtgaaccaagcgaatgttgacgcacgaaacagaaacggggacctcccctatgtgagcaagatggccggatccttccagaaagctagggcccgccaggtcacaatttctccgatcggcgaactgcgggatcctggttttaagggctga

SEQ ID NO: 2619 - RNA, 3135 nt, synthetic construct
  misc_feature 1..3135: note = Cas9 variant
  source 1..3135: mol_type = other RNA
atgaagtacaccctgggcctcgaccttgggtataacagcatcggatgggccattctggagaatgatgaaaacggttcccccataaaattgttcaatgctggcgtgcacatctttgagccttctattgaagacatcgagattgatgggaagggaaaaacaaagaacgtcaaaagaagggaagcacggttacgccgacgtcagctgttcagaaagactaagaggctagagaaactcctgaactttttcatccaagagggctttttccagaatcagaaggttcttataaatgacccatttgaacgggccgagttcctgtaccagttggataaaaagtcacgcaacccgtatatcctcagaagggaagcgctggacaatcggctgagtctcgaggagattgctcgcatcttttaccatattgcccaacaccgaggtttcaaaagcacgaagagagaattagcagagatgaacaaggatgaaaagaagaaaaaggaggacgggatcatacagtccgaaattaataccctgaaagaggagatcaagaaaaactcttgcaggacacttggagaatattttgccaagttgttcgagaatggcgaaaagattcggggccgtcatactgatcgcaaaatgtacgaggaagagtttcagaagatcttcaacaaacagaaggagttctatcccaatatctttaccgacgagttcaaaaagaagctgtacaaactaatttttcaccaaagagagctcaagtcgcagaaagataaggtggggttctgttcactggaaaggggtaaaaagcgggctcctcttgcactgttggtaagccagcgataccgctatatgtgcaaggtgaacaacctcaatgtcatagacacagagaccggagaaaacagagagctgactgtggatgagaaaaagaaattatacgaaaagctggagaatagtgaaaaactctcctttaaggagatcaagaaaattcttaacctgtctgagaagaggtatatcttcaatttggagaaaagcgaaaagtacataattggcaacaaaacaaatgttaagatgaaaaacatcatcaaggactgggacaattttgatgaagacaagaaaaacttctttattaatgaggcccggaccgtggtcaagatcgaaacgctagagcgcagagggaaaaagctgggactctccgatgaggaatcaaaagagttcagtaaggtggtatttgaagacggctatctgaacttcagcaagaaagctgttgagaaacttctgccatacttgaaagaaggtaagaaagagtatgaggccattaagctcgcgtaccccgaaaattctgtgcagaacgataatctgaaggagttagactttctgcctccaataaaatccaaggaactcaaaaagtacttcgaggtcaggaaccccatcgtggaaaaagcactaactgagacccgttatctggtgaacttccttattaagaagtacgggaaacctgagacaatcaagatcgaattggcccgggagctgaaactctcaaataagcaaaaagaacgaaagcataaagagaaccaggagaatagaaagaagagggaagaggtcattgaaaaactgaagaacgatcttaaaataagcgagccaactgaaacccagatccaaaagtatctgttggctgaggagtgtgactgcaaatgtccgtacacaggacgcagtatttctatggattccctctttggcgaacaccccctgttcgacatcgagcacattatcccttttgatcggagcttagacaattcgttcctgaacaagaccctatgctattctgaagagaatagaaaggttaaacataacaagacgccatacgaagcctattacggcactgagaaatgggaggcaataatcgaaagggtgaagaaatttaagtccaatgtacgcaacgagaagctccgacggttccagatgacaaaagaagacgtggagaattacattcagaacttttcaacccagaatctgaacgatactaagtatgctagtaaacttgccaagaaatacttggggctgctctatggaagcatcaatgaagacggtattgataagaaccgtaagagaaggatcttcgcgtcctctggcaaagtcacaagcaccctgcgctacgccttagggctgaacacgatacttaatgacgagaacattaagacccgggaggatcacagacatcacgcaatcgacgctattacaatcgccttgactgattcaagtatgatcaaaaagatatccgacgctagcaaaagggaaaagaatattaactctctctttaaggatttccaagccccctgggagaattttcgaaaagaagtggaggagatcattgcaaagatgaacatctcaatacgcattaataaaaaggttagtggacagatccacgacgaaaccttctataaaaagccttttaaagaggaagaaaagagctacacacatcagcggatcaacctggaggaactaactattaaggatgaggacaaaaagaaacagtcctctaagctgatcgataatattgtggactcgaaaataagaaacatcattatcaatagcctcaacggcgaaaagccaaagattaggttcaaagaccccaaggatcacccgtatatcatacagaaaaatggtaagaaaatccaaattcataaggtcaccatcaagacaaaactggagacctacaacgaaattgggcctgagaaggccaaacgttacgtgaagtcctcagacagtcaccatatcgaaatattcgaggatcttaaaactaagaagtgggacggctatgtagtttctttgctggaggcttacgaacgcaaaaagaaaaagttacccattgtgaataaaaacctcggagagggcaagaaatttctgttcagccttgcgaagggggaaatcatcgagctggatacggaaaacggaaagcgggagttgtttgtcgtgagaattatatccgcatcaaataaccagatcaaattcacaaggattaatgacagccgaaagatcaccgatattccagccactggtctcaccgcttgtccttcttccctgaaaaagcggaactgcaaaaaggtcgtgatcaatatactaggcgagaagcactatagtaacgactga

SEQ ID NO: 2620 - RNA, 3135 nt, synthetic construct
  misc_feature 1..3135: note = Cas9 variant
  source 1..3135: mol_type = other RNA
atggccgagaagaaattcaagtacagactgggcctcgaccttgggaccaacagcatcggatggtgcatgctgaggttgaataaagataacgaacccgctgcagtgattaagtccggtgtccggatatttcacgacggccgcaatgagaaaacaaaggaacctttagccgttgtgcgacgtaacgcgagatctatcaggcggaatctggatcgcaagatttcaagaaggaaccatctactcaatactctggtaaaatatttccttctgccaagtaacgagatcgaacggaaggctttggccgtgctcaatccgtacgagctgcgcagccgagcagtcaacgagagactggaactctttgagttagggaggctgcttatgcacttgtccaaacggcgtggattcaagtctaatcgcaaagtggacaaggaagattcgtcaggcaagattaaacccgccatcgagagactgaagaacaaaatgcaggagacgaataagaaaaccgctggtgaatatctatacagcctcatgcaaaacgggaagcctgttagggcacggctgggacgaatagacggcagtaatggctatgagatctaccttgatcgcgccctgattgaagaggaatataacttgatcatgaacgagcagaaaaagcatcacaaggagctcacagacgatattatcaatgaaatatttaacattatcttctaccagagaccactgaaaaagcagattatcgggaaatgttccttaactggagaggacaccaagctgaaaaaggctcatgtgctcgcccaagattttatccttctgcagaaggtccaggacttgagggtgttcgatgacaatcagctagaatttcggcccctgtctaacgacgagaaagatattataaagcgcgaactcaggaaaaagaaagaggtaagctacgagaatatcagaaagctgcttaagaaatattacgaaaacgttaagtatggtatgttctcccacgagacactgtacaaaaagttgcaaggcaataaaaccaacgcgctcatgtcagacaaggaaattatcggggatagttggtatagcctgtctcctgaggtgcagtacgacataattgaagagttatattccgataaggacaatgatgagctgtcaaaactatacagcgaaaagtttaacctcaatgagagtcagatcaacggactgcttaataaagcaatctaccgtttggactctggctatattcggtacggtaagactgccgtcacaaacctcaattccatcatggataaagacaacctgaacctgcacgatgctcgagaagaggccgggtatgagaaggaaaataaacaggacgcaagcgagtaccttgaatattacggaaaggtgctgccagactcggtggtcgatccccaaattgagaaccctaagaatgacgaagagagatatggcaaaatagctaacccaaccgttcatgccgcgttgaatcagctcaggaagctggtgaacgagttaatcaaactgtacggcaagccggaacagattgtaatcgagctagcccgcgatctcaaaaattctcggaaggcaaaggacgtgatcaacaaaaagattgctgaaaatagaaaactgaacgaggaagtcgataagacgcttcaagagtactccgagaaatataatactcacatagtgaagaacaagttgaatagggacaaagttaagctgtggcgcgaactcgggaaagatcccctggagcgaaagtgcatctacaccggagaacagattaacatcgccaaattattctcagacgaggtgcagattgaacatatcgtcccttatagtaagacactggatgacagctttaataacaagactctttccatgaaacaggctaactactataagggtaataaaaccccatacgaggccttcaaggattctaaagacggctataactacgatgacataatcgcacgggccaagttgctcaataacgacaataaattcaagcgttttacaaaggatgctatggacatttacaacagagatgggaaagacttcatcgcgaggcaactgagcgatacccagtatctatcaacgcgcgcactgatttacctccagagtctgtatgagaaggcccaccactccagcatctggactatacccggacagcttacagctttgattcggaattacctgggcttaaacaccctcatctctaatgacaaaaacaagaatagaaacgatcataggcaccatgccgtggacgcatttgtagttgccgtgacttcacgaagtctgcttcagaaaattagctatgctgcctccctgcaagaagatttggacaatcgcaacgtctcttcgtaccggaataagctcctggagaagatgcctgaaccattccccaactatagaaaaagcctagagctggcaatcgataacataaagacatcccacaaagcggacaggtcaatcagtggtaagctccatgaggataccgcttacgggattgtggaaaatgacgacaaatacaacgtcgtgacgcgttggaccgttgataagtttaaggagcagaaacacttcgaaacaatccgcgacaatgagctgaaggaaattgcctgttctgataaagagctttttgcaaagatcgtggagactcggaaaataaagagcattagaaagttggccaaagaaaacccggtaatcaagatcaaagacaagtccggcagggattataaggctttcgccggaggcaataacatttgcgtcgagatctacgaagtggacggggttcgaaagtcagaggtgattcagctgtttgatgcagctcaaaagggattcatgcctgaatggatgaaaaagtatcccaatggtaaattactcatgcggctgtttaagggcgacgtcatagggttcatcgagaaccgcaaatacaattattacaccattaagggaatcagcattgccgatcagaaccttaaactgctagcgatcaataaggccgagggcatatttaagaaaggtctcaacatcctgttcgactctaataacaaaaattccttgaacgctaaacagttcaatattagtgtgacagggatcgtaactaagaaaaagaccgcagatgtgaacttttggaagaacagaaaatga

SEQ ID NO: 2621 - RNA, 3135 nt, synthetic construct
  misc_feature 1..3135: note = Cas9 variant
  source 1..3135: mol_type = other RNA
atgctgcacaagatgagatacaggctcgcccttgacctgggcagcacctccttggggtgggctatggtgcggttaaacgcaaatcagcaaccctgcgccgtcatcaaagcgggagttcgcattttctctaacggtcgaaatcctaaggatggctcaagtctggctgtgacacgtagagaggccaggagcatgcggcgcagaagggaccggctactcaaacgcaaggcacgaatgatgagaactctgatagaatatgggtttttcccagccaacgagacgcagaggaaagctcttgaaaatctgaacccgtacgcattgcgggccaagggactcgatgaggctctgaccccctccgaatttgcccgtgcgctgttccatatcaatcagcgcagaggctttaagtctaacaggaaaacagacaagaaagattcggactcaggtgcactcaagactgccattaaacagttacacagcgtactggatcctcaagggaatgacggaaagccacggaccgtgggcgagcttttgtataagcgattcacagatctgagtaaactacccaaggaccgcaccgtcagagctaggtaccggcaggataaaatcgtgaaggacgatggcaaaactaagattgacaaatattacgacctctatatcgatcgcgccatgatagagcaggaatttgacgcactgtggaagaagcagtccgagcttaaccctatcctgttcacagaaaatgctagagccgatttgaaagacgttctcctgtaccaaaggtctttaaagccagtgaaacccgggcgttgtacctttatgagcgaggaggaacgggcgcctctggccctcccatccacgcagcgattcagaatgtaccaggaggtcaacaatcttaggattctgcgcgaaggattgaaggaggaatcactaactctgcagcaacgggatgacctcatcaacgcactggagaaaaataacagaaggacctttacacagattaagaagctgctgggtgtgggcgggagtgtacagttcaactttgaggatccgaaacgcgaagagttgaagggaaatactaccagcgctatcctcggcaaatctgaacatttcggtgaggcctggttcgcttttaacgaagccaagcaagacgcaatagttctgcagttaattaaagaggagaatgaagccaagctggtgcgatggctacaggatgagacagggatcgacgaaaagcgggctgaggtcattgcgaacgcaggactccccgaaggctatggctccctgtgcatcgaggcccttgctcgtatcttgcctgagctgagaagggatgtggtgacctacgacaaagccgtccaggcagccgggttcgaacaccattcaaagctcaatcgcaacgaggaaattccagacataacgtttaaaatcgagagcattgatcggaatagtggagagatcaagcaattccaccttcacaaagaacttccctattacggtgagtatctgcagagacatgttggctttgggtctggaaagcctgaagactccatagagaagaggtacggcaaaattgctaacccaactgtgcacatcggtttgaatcaggtacgagtggtcgtgaacgccctcatcaagcgctatgggcatcccagcgaaattatcgttgaggtggcacgggatctgaaacagtcgaaggacagaagggatgaggaaaataaacgtcaagcggagaaccagaagcgcaatgaacggttaagaaaagacattgctgatatactgggcatctctgaggaaagggtccgacgggacgatattgagaagatgatcctatgggaggaactctccttcgacccggccgatcgcagatgtccttactcaggagtgcaggtaagtacagttatgctgcttagcgacgaggtggaagtcgagcacatcttgcccttttcccagaccctggatgactctctcaacaataagactgtggcactgaggcaagccaaccggattaaaggcaaccgaacaccatgggaggctttcgggaccagcaatatatcaggatttgactacagtggtatcttaacgagagccgaactgatgcctaaggcaaaacgctataggttcgctgaggatggctaccagcgttggcttaaggacgatgccgggtttttggcgcgggccctcaacgacaccagacacctgtccaaaattgctagggaatatatgagcctaatctgccccaatacacgcgtcattccaggacagatgactgcaatgctgcgaagaaacttcggcctcaatgatgtgctgggtcttaacggggagaagaatcggaacgaccataggcaccatgccgttgatgcttgtgtgatcgccgtaaccgaccagggcttgctgcaacgctttgcagcggcctctgcttcagcccgtgaaagacagttaaatcggctcgtcgagaacatgcccctgccttgggagagttacagggaacacgtgcgccgagcaatagatggaatctgggttagccatagaccagaccactcccacgagggcgctatgcataatgatacagcctatgggcttcggggaaacggtagggtgtctttccacaagatggtcgaaggcaaacgcgagtacattgaagacaatctgaaggtgatcgagattactgataccaaagcaatcgacagacatgggttgctcccgacaggaaagcccaggccttataaaggctacaagggtgactcgaactactgcatagagattgtacggaatgaaaaggggcgttgggagggcgaaatcattagcaccttcgatgcctatcagctggtgcgcaaatacggaatcgttcaactacgatatccagtcctgtccgtgtcaggcaagcccctcgtgatgagactgataaggaacgactttgtccggcttgagcacgaagggatcactcgcacgttgagagtttgtaaaatgagggaggatggacaggtggctctggcggacgtgacagaggccaacgtagatgcacggacccgaactaaggaaatttgctacgtcttcaaaaccggcggtagtttacagaaggctaaggccagacgcatcacaatttctcctatcggggagctcagggacccaggatttaaagaatga

SEQ ID NO: 2622 - RNA, 3138 nt, synthetic construct
  misc_feature 1..3138: note = Cas9 variant
  source 1..3138: mol_type = other RNA
atgcagaaggagaaacccctggcctacagactcgctcttgacctgggcagcacctccttggggtgggcagtgttaaggctgtctgcccctggagaaccatcagcggtcatccgggctggtagtcgcattttcagcgatggccgaaacccgaaggacgggtcctctctagccgttacacgtagagcagccagggctatgcggcgcagaagggatcggctcctgaaacgcaaggcacgaatgcttgccgctctggagagacacggatttttcccccaagacgaagccgcgaggaaagcattggagaagctcaatccttatggcctgcgggcccgtggtctggaatcggctctcaagccagaggagtttgggcgcgccttattccatctgaaccagagaaggggatttcagtcaaatcggaaaactgatcgaaaggacagcgatagtggcgcacttaaacaggctataggcacgttgcgcgcccaaatgcacgaatccgggtgcagaaccgtgggagagtggttctggaaggtaaggatggaacggaaacccgagggtgtgaagggccagggggtccgcgcgagatacagggagacaccttttactaccgacgaaggaaagaaacgtatcgataagcggtatgacctgtacgtggatcgagccatggttgcacaggagttcgacgctctatgggccgctcaggccacatttgcaccagccctcttcaacgaagctgcgagagcagagctgagggatattcttctgcatcaacgcaaattgcggcccgtgcagcctggcagatgtaccctcgtcccagaagaaccgagggccctgttagctctgccctctactcagcgctttcgaatctatcaggaggtgaatcacctccgggtacttcatgacgaactgcgtgaggaagccttgacactagcacaaagagaccagattgttgccctgctcgagaggcaggctaaggtgaccttcacggccatgcgcaaagcactgggttttagcgcgcttttcaacctggaagatgctaagcgggacgggttgaaaggaaatgccactaccgcagccctcggcaagaaggatctgttcggccctttatgggctgggtttgacacagccctgcaagatgagatcgtcactcagctaatgaccgaggaatccgagccaagactcatagcatggctgcaggaacacacaggagtggacgaggctagggcccaggcgatcgccaacgctggtcttcccgaaggctacgggtcattgggacgaaccgcactggcccgcattgtgcctgagctccaacgggatgtcatcacgtatgacaaagctgttcaggccgcaggcttcgcgcaccatagtgatctgggttttagcttcgagcacgacgccgatgaagtggagagaattggggaaaggactatcgcttctacaggcgagataaagccagtatttgccttcaaacagcttccctactacggacgtgcactgcagcgccatgtggcttttgccaaggagaatccgcggaacgacgaagagagatatggcaaaattgcaaatcctaccgtccacatcgggttgaaccaagtgagggttgtggtcaatgccctcatgtgccgatacggacggcccactgaagtggtaattgagctggctcgcgacttaaagcagtccagagaacagaagctggaggcgcagcaaaggcaggccgataaccagaaacggaatgcacgaatcagacgctcaatcgctgaggttctaggtattagcgaagagagggtgcgtacactcgacatacagaagtggatcctgtgggaggagcttagtcacgatgccgccgaccggagatgtccatattctggcgtccaaatttccgctagcatgttgctgggggaaagggtggagatcgagcatatactccctttctcgatgaccctggatgactctttaaacaaccgcacggtcgcactgcgagaagccaatagaattaaacggaacaggaccccctgggatgcgcgcacagactttgaggctcacggatggtcctacgatggcatccttcagcgtgccgaaagaatgccacagcggaagaggcatcgcttcgcacccgacggttatgagcgatggttgggggaagataaagactttctcgccagagctctgaatgatactcggtacctatcaagggtggcagccgagtatctgcgcctcgtttgccctggcagtgcgaccagagtgatcccaggacaaatgacagctctgcttaggggcaagttcgggttgaacgacgtactgggattagacggtgagaagaatcggaacgatcaccgtcatcacgccgtcgacgcatgtgtgattggcgttactgatcagcgcatgatgcagcgatttgcccaggctaatgcccaagcaagagaagacgggctcaccaggctggtggaggatatgccgcttccctggcctacataccgggctcacgtcgaacgcgccgtgagacatatctgggtaagccacaaaccagaccatggattcgagggcgcgatgatggaggaaacctcctacggtattctgagggatgggactataaagcagcggcgaaaagccgacggctctgcaggaagagagatcagccgcttgattaggatcacggaaccctcacagcctcagcggcacggcgtggatgctgaggggcgtccactcccctataagggatacgttggcggtagtaactattgcctggaaatcacagtcaatgacaaagggaagtgggagggacaagtgatttccaccttcgatgcctacagaatagtgagggagggcggtctacgccagctgcggcacagcactcagggccagaacgggcaagctctcgcaatgcgactggtcatcggagactctgttagacttgaagtggatgagcaggaaagggtgatgcgcattgtaaagatcaatggcaacaatgggcaggtctttatggccccggtgcatgaggccaacgttgacgctcggaatagcgacaaaaacgaagcgttcgcatataccagtaagattgccggatcatttcagaaaacaaaggctagacaagtgaccatctcccctataggcgagttgcgtgatccaggtttcaaagggtga

SEQ ID NO: 2623 - RNA, 3138 nt, synthetic construct
  misc_feature 1..3138: note = Cas9 variant
  source 1..3138: mol_type = other RNA
atgaagcccagaaacctgaattacatcctcggccttgacctggggattgccagcgtgggatggtccgtcgttgagatagatgaaaacgagtatcctatcaggttgattgacgtgggtgtacggaccttcgaacgcgctgaggtgccaaaaacaggcgaatctttagcactggcccgacgtctagcgagatcaactaggcggctcatccgcagaagggcttttcggctgcttaaggccaaacgcctgttgaagcaccatcagattgtcaatgcagaggagctcacgcaactgccgaaccagtgctgggaactgcgagtgaaagggctcgatagtttactgagcaataccgagtgggccgctgttcttttgcatctgctaaagcacagaggatacctctcccagaggaagaacgaagcacagaatgccgacaaagagctgggcaagctgcgggagggtatggataacaattctaaactgttgctcgaaaacaattatcgtacacccgctgacatcgccgtgaagaaattcgcggtcgaggaagggcacatgcgcaaccaaagaggagcatacactcatacctttaataggctggatatattagccgagatgcagcttctcttcaagacacagcgggaacttggctcgacctatgctaacggcgagctggagcaggccttttgtgaattgctactgtggcaaaagcaggcactcaatcgatcacagatgctgagccttgtggggaaatgcactttcgagaaggaagagaaacgcgctgccaaggcgagttactccgccgaaagatttgtagcaatccagaaactgcaaaacttgaggattctcgagaacggagaggaacggggtctgttcgactctgagtttagcttactgctagaaaatgcttataacctcaagtccggcctgacatacaaacaggttcgcaagatcctttcattgagtgagaatgccattttcaaggggctgccttacctcagcgatgacctggaaaaaccagagaagacccagtttcttgctttcaaattttatcaccaactggccgatatcttgaagaacaatggattctctgacgagtggcagaaactctcccaggaacccacgctgttagataagctgggcactgagctatcactctgtaaggaagagaacgagttcatagcacagtttaatggtgaactgcctgaggccatgcttagcaccttgttcaaccacacaaattttgacaaattcattcatatcagtctgaaggctctcaacaatattctgccattaatggaacaagggaacgactacactaaagcgtggagaaaggtgtatcccgagcctaccaaaaaggatgaaaagacactgccaccgatccccgcagacgagatcaggaatcctgtcgtgcttcgttctttgtcccaggcccggaaagtgattaacgctgtcatacgactctacggaagcccagccagaatccacattgagaccgcaagggaactgggcaagtcgtatgatgaccgccagaaaatcaagaaacagcaagataaaaattctgacgagcgggatcaggccgttaagaagtttctagaagagtgccccaacttcgctaacaaggtgaaaggcaaggacatactgaaaattagactctacatcaatcaggatgggaagtgtctgtattccggaaaacctcttgacccacataggttgctggaaatcggttacgtagagattgatcacgccttacccttttcacgcacgtgggacgacagtcagaacaataaggtgctcgtcctggcaaacgagaatcaaaacaagggcaatcagactccgttcgaatggcttgggaaagatgagcaccagtgggcgctgtttgtggctcgagttaacggatgccggttcccttacgccaagaaacagcgtatcttgacaaagaaactcgacgaacaaggctttctgaagagaaatctaaacgataccaggtatgtgagcgcatacctgatgaagcatattaaagagaatctccacctggtcggtaaggggtccgacaaagtgttcgcctctaacggccaggtaactaattttcttcgccggtgttggggattggaaaagaaaagagaggagggcgataggcatcacgctctggacgccatagttgtggcatgcagcacagcttcaatgcgacagaagatcaccttattcaagaaatatcaacgctggaacctcaagacggggaaacatattgatcaggaaaccggagagatcatccccctgcacttcccagccccttgggactttttccggcaggaagtcatgattagaatatttagtgagatgccccaggaggatcttatcatgcaactgccagacaggccccaggcgaatcacgagttcgtgcagcctctatttgtctcccgtgccccaagccgcaagatgtctggtcagggccatgaagctaaactccggtcagcaagaatgctggaagccacagggaagagtattaagaaagagttcttgactgatctgaccatcaagaacttagaacacatggtgaacaaagagagggagccggaactctaccaagctctggttgagcattttaagaaatatggagacaagcccaaagaaaagttctttaagaaaggcggtgtggaggtaaagagcattcgaatctccaaaacacagaataagtctgtcaaccttgggaataaaactatagccgataacggcgacatcgtgcggaccgacctgttcttgaagaataagaaatactattttgttaacatttacgcatggcaagtgtcgaagggaatcctccctaaagaaacaaccactggcaatattctggataacagctacgagttccagttttccctattcaagaatgacctgcttgagatcccacaccccaaaaacgaaaatgattcaatactcgcgtatttcattcgccctgacgatgagagaaggtggatcctgaagtttcacgacaacgccaagattccagatatctacgggaaaaaggacgaaacgagtatacggttgtctatccagggacagaaattcattaagaaatatcaggtcgatgagctgggtaagaatatccgaccctgtagaccgacaaagcgccaaggcgtgaggtga

SEQ ID NO: 2624 - RNA, 3141 nt, synthetic construct
  misc_feature 1..3141: note = Cas9 variant
  source 1..3141: mol_type = other RNA
atgaagatctacagcttcgacattggcgtggcctccatagggtgggcttttatcgagaacgaagtcctgcaggattgcggaattagaatcttcaccaaagcagagaatcccaagaacggtgcctctctcgcgcttcctaggcgggaagctcgcggcgttcgaaaacgtctggccagaaggcgggggcgcttgaatacaattaagcagttactgtgtaaagagtttggactacagctcgaagactatctgtcaaacgatggcgagcttccaaaggcatacactgccagtaaggctaatccgctgaaaagcccctatgagttgagaacgctcgcactgtcccagaagctggactctaaagatctcgtgagggtaatcttacacatagccaagcatcggggttacgggaacaaacacgctaaggactcgaaggataccgaatcaggaaaagtgaagaaagccatcgagttcaatcgcaagacactggcggaaaaaggctatcgaagcgtcggcgagtacctttatagagagtttttccagcaaagtaggatttcccagaacaatggggcaactgaatttgtgaacgttcggaataagaccggaaactacgagcattgcgtggcccaggacatgttgaaagatgaactggagctaatcttccgtaagcagaaggaactcggtctgcacctttctgacggctttgagaaacaactgttggataagattttcgagcagcgccctctcaagagctttgctgacaaagtcgggaaatgtcagttcatcgccggagcaaagagagctccaaaggattccatatcagccattgaatttgtggcgctgagtaggatcattaatacattagccaacctgagcaaaaagtctggcgagatgtacgacaaagcaatggtactcaccatccttgactccgttctggaaaagggtgagatgtcatattacgctttgcgggaagccatcaatctagatgagaaaattcgattcgctgacagccgcctggattatagtaaggagataaaggaaactgagaaagtgaagttcgtcgaatgcaaaaacctcaagtcttttaaaaaggtgctggggaactgttacaagacacttgagagaaaacatatcgactccattgccgaaaggatcgcagtgataaaggatgtcgagaaactgcacaaggagttggaaagctattgcgccaccgagcagctctcgctgacgtctgaacaaattcaggctttatcccacctgaatttctcaagtcatatcagcctatccctcaaagcgctggagcagatccttccctttatgcggggagagcgcgaagcaagatctagcgacgccgattactgtattggcatcgacgagtcaggcgaaagtcaatgcttgaggtatgatgagtccgttgaaaaggctgggctgaaagccctcagcaaggacactctgaagggacagattcttcctccactgaacgagttcgagccctacttggcaaatcctgtggtagcccgtgctctcgccgaataccggaaagtgctgaacgcattactgaagcagtatggttctccacacaaaatacatatcgagtacgcgcgagaagctaagctaaataccacagagagacagaaatatgaaaaggagcaaaaggataactacgccgcaaatcaggccgctcacaaaaagtgtcaggagctcggcctggaaccgtcaagtactaaccttttgaaactgaagctctggcaggagcaagggggactgtgcttatatagcggcgccaaaattaccatctcctacctgcaggaccccacagcacttcaggtcgaccacatctatccttactctaggtcgtttgatgacagctacatgaataagtgtttggtgctcaccaaggctaaccaggaaaaaggtaatcgcacgccattcgaggcctttgggactgattccgcgaagtggggcgttattacaaccctggcccaaaaactaccccataagaaacggagaaggatactgaacactgctttcaatgacaaggaagcaggatttaagctccgcaacctgaatgatacatcatatatcgcccgacttgtggctgactacaccgagacgtatttggagttcctgagtttagtcgaatctgagaacaccacactcggcaaagggcagaagggaagcaaaaagcacattgccatcgtgaacggtgcactgacttccaccatgcggtactatcttggctttgcgtcaaaagatcgtgacaatcatctgcaccatgccttggatgctgtaattatcgggttcatgaacgacagcgttataaaggccttttctgatttcaaaaagacacaggaaacttccaaggcagcttactatgcccacaccctcagtaaacaggagtacaagaaacaaagagcattcatccagctgcctagcggagagaattttagggccaacgtgctagaaaaggctgagtctgtcttcgtgtccaaaccaccccgcaagcgggtcagaggcgcgctgcacgaagagtcattttacagtcagaatgacacaaagctcctgaaaagctatggtggggccgaaggcattgagaaggcacttcaattgggaaaaatcaggcagattggcaccaagatcgtgtcgaacggggctatggttcgagtggatatattcaaacatcgcaagtccggaaagttttacggtgtaccggtctatactatggacttcgccctgggcattttacctaataaagccgtggttcaggggaaggacaaaaacgatgtgatcaaggactggctcgagatggattctagctacgaatttattttctcactgtataaagacgatcttctgctagtccagaagaaggagatggctgaacccgagctctgctactttgtgagtttcgacacgtccggagcatctatcaaagtagccaagcacgataataactttagcacactgaccgaaaatcaaaaattgctgttctccaacgcgactaaggaggaggtggttggcaaatcaataggtatccagaatttaaaggtctttgaaaagtggcaagtgagcgtgctcggggaggtcaaacggacccagagttatccaagagaaaacatttctctggcttccaaggccaaaaagtga

SEQ ID NO: 2625 - RNA, 3144 nt, synthetic construct
  misc_feature 1..3144: note = Cas9 variant
  source 1..3144: mol_type = other RNA
atgaagctgctcagatacatccttggcctggacttggggattgccagcgtgggatgggctatagtcgagatcgatgaaaacgacttccccattaggttaatcgatattggtgttcggacctttgacaaagcagaggtgtccaagacaggcgaatctctggccctagcgcgccgactcgctcgttcaactagaaggctgatccggcgcagagccttcaggcttctgaaagggaagcggttgctcaaacagcacaatgtaataaacaaggaggcactgacgaccctgcctacagattgctgggccctccgcgtgaagggattagacgaacgactgagtccaactgagtggagcgctgtccttttgcatctgctaaaacacagaggctatctctcccaaaggaagaatgaggcaaaatctgccgataaggaaatgggtgctctgctttcgggggtggcctcaaaccatcagctgttggttgagaatcagtttcggaccccggcggaaatcgcagtgaaaaagttcgccctcgaggagggacacattcgtaaccagctgggcgcttacacacatacctttaatcgcttagacctgctcgccgaaatgaaacttctgttccaaactcagagagagttgggcaacccccacacaagcgggcagctagaacaggagttttgtgaactgctcatgtggcaaaagcctgcactgagtggagatgctatccttaagatgctgggtaaatgcaccttcgagacgaatgagtataaggccgcgaaacactcctacactgccgaaaggtttgtctggttgaccaagctcaacaatctgcggattttagagcatggctctgaacgagtgctgaacacagacgagcgcagcctactcctgaatcagccatatgaaaaagcaaaacttacttacacccaggtaagaaagttgctggggctctccgaggaggctaggttcaacggagttcggtatggcaaggaaaaggccgaggatgctacactgatcgaacttaaagcctaccacgcaatacgcaaggccgtggagaaagctgacaagtcagcgtgggaaaccctgaagaatcagacggcattgctcgatgagattggtactacatttagtatctacaaaaccgacgacgatattactgagcaactgaacgggaagttaagcgacacagtcctgaacgccctactcgaaaatctgaacttcgataaatttatccagctttctttgaagtccctgtataatatcgtgcccctcatggagcagggactgagatacgacgaggcttgtcaacagatttatggcgatcatttcggcaaaaagtcaggggagataaacaggttactgcctccaatccccgccgacgagattcgtaatcctgtggtccttcggagcttgacccaggcacgaaaggttatcaacgccgtgataagactctacggaagtccagctaggattcacatcgaaacggcccgcgagctgggtaaatcttataaggatcggaaagaaatcgagaagagacaggaacaaaatagggcagagcgcgagaaagcgaccgctcagttcaagacactatttccgactttcattggcgaacccaaggggaaagacatcctgatgatgcgactctacgagcagcagaacggacaatgcctgtattccggcaagcctcttaatttgaaccggctgttagaaaaaggttacgtagagattgatcacagcctcccattttcgcgtacctgggacgattctcagaataacaaggtgctggtccttgccggggaaaatcagaacaaaggcaatcagacacccttcgagtggctgggaaaggacgagcatcaatgggcattgtttgtggccagagttaacggctgtaggttcccttacgctaaaaagcagcgcatactcactcagaagctggacgaacaggggtttatcgagcggaacctaaatgataccagatatattgccaggttcctggtgaactttgtccgagaaaatctccacctgacaggaaaaggtaagaaccgcgtgttcgcatccaatggccaaatcaccgcttttcttcgggggagatggggattgtcaaaagtaagggaggaaagtgaccgtcatcacgccctggatgcggttgtggtcgcctgcagcactgtggctatgcagcagaagatcacgcgcttcgtcaaataccaagagggcaacttacagacagcagagcggattgacagagaaaccggtgagataatcccactccattttcccgatccgtggcacttcttcaggcaggaagtgatgattcgaatcttttccgagaatcctcaggaggacctgattatccaacttcccgatcggccagaagccaaccacgagttcgttcagcctctgtttgtgtctcgcatgcccactagaaagatgagcgggcagggccatatggaaaccataaagtcagctaaaaggctagacgagggaatcagtgtatccaaggtcccactcacacagctgaaattgaaggatctggacaatatggtgaaccgggaacgagagaaagccttatatgaggcactcaaggcgagactgaatgccttcaacgatgaccccaccaaggcttttgccgaacctttctacaaaaagggcgggcaacaggttaaagcagtgcgcgtcgaacaggtgcagaagtctggagtagtggttaggaatggtaacggcgtcgctgataatgccagcatggtgcgtgtggacgtctttattaaagggggaaagtatttccttgttccaatctacacttggcaagtggcaaagggcattctgccggaccgggccgtggtagctgcgaaagatgaatcagagtgggaattgatggacaagacagcccagtttctcttcagtatgtttcccaacgatctgatccaggtcaaaacgaagaaagagaccttctttggttattacaacgggctagacagagcaactggcgctataaatctgaaggagcctgatagcaacattaataaaggaaagtccggccttcacaggtctatcggggtgaagacagccctctcggttgaaaaataccaagtggacgagctgggaaagaacattcgcccatgtcgacccagcaaaagacaggccgtccggtga

SEQ ID NO: 2626 - RNA, 3147 nt, synthetic construct
  misc_feature 1..3147: note = Cas9 variant
  source 1..3147: mol_type = other RNA
atgaagagactgggcctcgacatcgggaccaacagcattggatggtgccttatagaggatgacggtgatggcaaagggaggatcattgacatcggagcccggattttctccgatggccgcgaccccaagtctggtgcttcactggcagtggatcgacgtgccgcgagagctatgaggcggcgcagagacaggtacttggggcggcgcacagcctttttaaaagcactgaagcgattcggactaatgcctgccgatgaaagtgctgcaaaactcctggccgacagagatccatatgagcttagggctcgggccctggacgaacgtttggagccgcacgaaatcggccgcgcgctctttcatctgaatcagagaaggggcttcaagagcaaccggaaggcagagcgaaaaactaaggatgccgaggacgggaaaatagctaatggagccaaggcactggaccaagctatggccgaatccggtgcggagacgctcggccagtttttatcttcgcgcgataccaaaagagtcaggatggggtcagacgcccagggatacgatttctatccccagcggcgccacgttgaatacgagtttgacacaatctggagcagacaacagcagcatcaccctgcactgcttactgaggaagctaggaagaagttgcatgatattctgttctttcagcgtccactaaaagagcaagaagtgggcgtatgtaccttcgtgcacaacgagtgccggctccccaaggcccaccctctgtttcaggaacgaagactttatgaggaggtcaatcagctggaaatcacaaccccaggtgctcccaacaggaaattgactatggacgagcgcgatgccctcattctggaattacggagtagaaaggagaggtccttcgactctctggcaaaacgcctcaaacttgcccctgggcagagctttaataaagcatccgaatcacgaacacggctgcgtggagatgaggtgtacgcggttatggcacataagaagagattcggcgacaggtggccacacttggatcgcgaccggcaatgggccatcataaaaagaattatcgaggaagaggacccggataagctacatgctttcctgaccggcgaatgggggctcacggacgagcaggccctggcaactgccagggctccccttcctgaactgtatggacgattgggtccaaccgccacagcacgcattctcgaggagctgaaaaaggatgtgatcacttacgacgaagcggtccggagagctggctggcaccacagtgatgacaggaccggggagatcttaccccagctgccttactatggagaactactcacacgtgatattccacccggcacccaagacccgaacgatcctcccgagcagcgctggggtaaaataacgaatccaactgtgcatatcgggctgcggcagcttgagaagttggtaaacgccattatcaaggttcacggcagacctgaccagatagtggtcgaactggcaagggagctcaaactgaatgaaaaggataaagaggaacataaccgacggattcgcagagacacagccgctgcccaacttaggagcgcaaagctgcagtctgagggaatccccgataccggcgctaatcggatgttgctccgaatctgggaggaactgaacccaggggaggtgttagacagacgctgtccctactgcggagaacctgtgggtatgaggatgctgtttgccggcgaggcggacattgatcacatcattccatattcccgttcactagacgatagcgccgggaataaagtcgttgctcatcggagttgtaacagagcaaagggaaacaggactccgtacgaaaagtgggtgcacgaccccgatcgctgggacgtaatatctacacaggtggcccgactccacaaatccaagcagtggagattcggccctgatgctatggcccgggtcgagaaagacggtgggtttatcgcaaggcaactgaccgatacgcagtatcttagccgcttggcgggccgttacctgtcgtctctctatccaaccaaggacgatggatccgtgtacgttattcccggcagaatgacagccatgctgcggaggcgctgggggttaaattcactgcttcctgaccataacttcgtggataatgagcacagtaacgctccaaagaatcgattggaccatagacaccacgccatcgacgcagctgtcgtggccgtaactacccgggcactcatgcaggaaatcgccaggacagctggacgcgcggaggataaggacctggatagactatttgaagacctgccccagccgtgggagggtttcagggaggaactcggcgagaagctggttcgggtgactgtcagccataaacctgatcacgggcgtaagggacttccacccaaaaaccgcgacgtgaccgccggccgattgcataatgatacagcatacggtctgaccggggacgtcgctgccgatggcaagactcctattgtggttcacagagtgcccttaatgtccctcaaaccagccgacatatctgatcctgacaggatccccgacccagctctgcggagcgcacttcatcgcgccacggatggactgtcaggcaaggcgtatgacgctgccttggcagggtttgccaaaacacacccgcaattcgctggaattagaagggtacgggtccgagaacctctcaccgtgatccccattgcagatagagacggccgcccatttaaggcctacaagggtgatgcgaacagtagggttgacatctggcggatgcccgatgggaaatggctgtccgacgtggtcactatgtatgaggctcaccgtagagatcatagcgacaggcgccctcacccagccgcaaagaaactaatgtctctgcggcagaatgatatgatagccgtggaacgagacggagctcccagacagatcatggtagtgaagcagatttggcctacccaaatcaacctcgttgagcataaagagacaggcaatctgaaggataggcactcaaacgaaaccgacccgttccgctttttcgccccaactgctggtggccttaagaaaatgaaggctcggcaggtcagaattgaccccttggggcgtatctttgatcctggaccaaggtga

SEQ ID NO: 2627 - RNA, 3147 nt, synthetic construct
  misc_feature 1..3147: note = Cas9 variant
  source 1..3147: mol_type = other RNA
atggccaacatcgctgagaatctggtgttcggcattgacctcgggataggaagctgcggttgggcagtccttaaccagaaggccaaagatgaaaatatcgttgcgctgggctcctggtgttttgacgtgcccgagaccgataaggaaaggattcctacaaaccaaatcagacgggctaatcgcttgttacgacgtgtaattagaaggcggcgcaacagaatggccgagatcaggcggctgttcgcatctaaagggatgctagacactgccgatccagacgctctcgcaaagatatcagccgatccgtgggaaatgcgcgctaaaggactggactaccagcttacgccccaggagtttgccgtggcgctgggccacatcgcaaagcgaagaggtttcaagagtgccgctaaaagggtcagcaccaatgccccttccgaggattctaagatgttggcagctctcgagaaaacaaaggagcagtcggcccaatatcggactattggggaaatgtttgcgcgtgacccagcctacgcagatcgcagaaggaaccgggacggatgcttcgatcgaaccatgtcacgcgaggacctgtttaaagagacacagatcctgttcgaaagccagagaaggctcggcaattttagtgctacctccgagactgaacaggccttcattgacatcgcttttcggcaaaagcccatgcaggattctgagcgcttagtggaaacatgtctgttcgagcctgacgagaagagagccagcaggtttgcaccatccttcgaacgtttccggcttttgtgccgactggttaacctaagagtgaccgatggcctcgaggacaggcccctgacgcctgaagaacttcgcctggcctgtgaagatgctgggaaaactcggaagttgtcagtcaaaaaggtgagaagtctcataggactgagggacgatcagcgctttaccacaattccaccggaccaggagcaacatgatatcgcggcacgaactggtgacgccttaaccggcacagctaccttccgggccattctgggggagagcttttggcgtcagctccttccccaccctgaacagctggatagagcagcctggatcatctctttccatgagttgacggacactattatatccaaactagctacaatcggactgccatcagaagtaatggagctcattaggaaggccctggaagacggcaaatttagcaagttcaagggtgcagcgagtctttctgataaagctgcccgcaagctgatcccctttttgcaagaggggctcacctatgacaaagcatgccagaaggccggatacaatcacgctgcctccaaattcactcattatgatagcatagacacaaaggcaaagtttaactcgctgatggatgacgttcgggattctattaccaatcctgtggctagaaaagccatctccgagggcatgaagcaggtctgggcgatgaggaaccagtggggcttaccaggggccatctgtattgaactggctcgagacgtgggaaattcagcagagaaacgccgggaaatcgagagtggtattaagaaaaacacggcccaaagagagagggaacgtcaggaggctaaggaacacctaaaccagagcgatatatcctctgagaccctcctgcgctaccggctttggaaggaacagggcgggagatgctgttatacagaccaacccatcactccgagccagttgattgcctcagataatagtgtgcaggtcgaccacatcctgccttggtccaggttcggagatgacagctacctcaacaaagcactgtgcaccgcgaaggccaatcaggagaaaaagaaccgaacaccctgggagtggatccataatcaaaaaggcgttgaggcttggaaccactttactgccgcagtggaatctcggaaggaaacccgcggtcttaagaaaagaaatttcctgttgaagtcaagtaaagagacagaagagaggtttcggagccgaaacctcaatgacaccagatacgctgcccgcgtaatggcagaggccgtgaggctgttatatccatccgggaaccgtgctgaaaagggcggagtcaaacgggtgttcactagacctggcgcgctgacggccgcactaaggcatgcttggggagttgagtctctcaagaaaattaatgggaagcgcctgaacgatgaccgacaccacgcccttgatgccgctgtggtcgcagccgtgtcggaaaaggagatacagaaattgacaaagagcttccagatctgtgaacagaaaggtctggcgagacccatgcgggacgtaccaatgccctgggagggctttaggcatcaactcgagaccgcttacgccgatattcgcgttgcacgtcctgaaagacggagggcccgcgggaagggacacgacgctactatccgacagctgagagaggaaaaagatggcccagtggtctatgagcggagggcaatttccgacttaaagctgaccgatcttgagcgcatcaaggacccggaaagaaattcagccataatcagttctttgaggacatggattgagaaaggtaagcccgcggattaccctccacagagccccaaaggggacgaaatccggaagattcgtgtgatgtcccgcaacaaacctgctgtctcagtgcgaggcggaaccgccgatagaggcgagatgactagggttgacgtgttcacaaagatggggaagaaaggaaagccagaatggtttctcgtacccatctatcggcatcaagtcatagaccgcattcagtggccgcagcctccaaatcaggcagccgctaacggtaaaagcgagaagaactggcccacgatgggcctggagcacgagttcagattttctctataccctaggtcctatgtgcaaatcgttaaacgggatggggaaattatcgaaggatacttcgccggcctggaccgaaccgtggcagcttttagtctcctgtctagctccgatcccacttcaatacagagaggtatcggggccaagacacttgagagtattcgcaagtacaatgtcaacaggttcggcgacatcagcatggtggaacaggagacccggacatggcatggagatgtatgcatttcgccagaccagcctgattccgcgtga

SEQ ID NO: 2628 - RNA, 3147 nt, synthetic construct
  misc_feature 1..3147: note = Cas9 variant
  source 1..3147: mol_type = other RNA
atggtggagaagatcctgggcattgacctcgggataagctcccttggatgggccgtcgttgaatacgataaagacaacgatgagaataacaagatcattgactgcggtgtgagactgttcaccgctgcagaaacacccaaagagaaggaatctcctaataaagccaggcgggatgcgcgcggcttgcgacgtgtaatcaagagaaggcgggtgcgcatgaacactattaagaatttactgatcacgtataaactaatagacaagaccctcctggatgaggagatggggatgtttcactcacagagtaacagagtcgacgtgtggaaacttaggcatgatgctctgtaccacttgctcagcggagacgaactggcccgggttctgatccatattgcaaagcaccgcggctataaattcctcggtgatgacgagtccgatgaagagtctgggaaggtgaagaaagccggagctgagttaaagaaaaagtttctggaagcaggctgtcaatcggtcggcgagtggctttggaaagaacgagggttgcagggaaagaaaagaaataagtcaggtgactacgagatcagcattccaagggacttcctggtggaagagatccagcggatatttgagacacagcaaaagttcggcagtacttttgccacctccgaactacagaaggcttatacagatattgccttctacgtaaagccgatgcagtctatcgaggacatggttgggtattgcaccttttaccccaaaattaagagcaaaaaccaggatggagaaaagcgtgcgcctaaggcatccccatcagccgagcaattcgtgatcctcagtaaaatctttagcactattgtcatagacgaaaataagcaggagaaaaagctgatcgagcttaaatctattgaacagctgatccagatagctcgctccaaggagacattgaagtacaaacaactcagaaaggaactgaacttagccaaagatatttcattcaagagcatcagtgacgaggagaaaacctggatcaatctggtgggcaacgcaaagtttaagaaaattctcggtcttaattatgaaacgttcctgaagaacactgagatctctgatgaaattgctaaaatattgacctacgacaagacattcgagcagaaagaaactaagctgaaaaatctactcgtgaacatcgattggattgacaacaatcatatcgccgagctggcgaaactttcctttagccagttcaaccaactgtcgttgaaggccatcaaaattatatctaagatcatgattgaggggtatgcaaggtacgatgaagctgtccagtatgcctttgagaataacctcctgcccaaaccttcccacgaaaagtcaatcttactgccacccctaaaagagaccaatattgctatcctcaaccctacagttatacgggccttcgcacagtttcgacaggtggccaatgctctggtaagtaagtacggcagcttcgacaaggtgcactttgaacttgcgcgcgaggtcaacaccaaagaggacagaaagaggtgggaaaaagatcgggacaagaatgagaaaatgcatcgccaaatcacggaaaagttggtggaggaaggagttaagccatcctataaaaacattctgaagtctaaactcagaagcgagcagaaggatacttgtccgtactgccagaaaaatctgcactaccccatgatcttcgaggacggctatgcagaaattgatcatatccttcctctgtcacagagtcaagacgattcctacgtgaacaaggtcttggtgcacagcgcctgtaatcagaacaagaaaaataggacaccatttgagtggttccaggacgaaaagaaagattgggacacctttaagtcttatatactcatggagtcaactctgggggagaaaaagcgtaactacttaattaaagaaaacttcagtgatccccagagccggaaggagtttatctcccgaaatctgaacgacacaagatatatgtctaaggctattaaaacctactgcgaaaatcactggaagctatcgcatgatgacgacaaactcaggatccaagtacgcagcggaaagctgacgtccacccttcggcaccagtggggtttggataacaaaaatagagagacacatactcaccatgccatggacgcaataatgatcgccttctcaacccagggcatggttaagaagctgagtgattatttcgctaaaaaggaagccaaagtggagaaggacaaacctgtcctcattacaccaatcaagcagtttaaggaggcagtggaacaagcgactaccctggagaggcaggaatctattcagacaaaagctggggataccatcactttaaaccgcctgcttataagccgacccccgcgggcctccgtcacgggagcagcccacgagcaaacagctaagccttacccccgtattaaaccaatcaagaataaatacaagagaaggcgcatccctattgacgaagataagttcgagttgtttcggaacgacaaagtggcctcaggcaatgataagaacttctataatagctctaccatccccagagttgacatttacaaaaaggatgacaaatatcacgtggtaccaatatacctctccgatatgactaaggcagaggtccccaacaagagtctgggtaccaatcctgaagggatggacgagaaatatttttgtttcagcgtgtttaagaacgacctaatcgaactggagacaaaagctaccccaaagaaaccgtctaagaaactcctgggctacttcaagcagcttaatggagccaactttattttgaactccatccataatggcattatcgatgggttcgtttgctcacccataactctgtttaagcagcagaaagacatgtgtaagaaatgcttacctgaagatagggcgatcggaaactgtagtcaagagacactcgagttctgggaagccgagaatattaaggtgcccaaaaaggactttgaatgcgatcagggtatcaagttcgctattgcagtccgaaaatatacgatcgacccactgggctactaccacgaggtgaagggggaaaaacttctgggaaccatacctcagggcgccaagaaacatccaaagcgccagaagtga

SEQ ID NO: 2629 - RNA, 3150 nt, synthetic construct
  misc_feature 1..3150: note = Cas9 variant
  source 1..3150: mol_type = other RNA
atgatcaacgagagactgaccttcggcattgacctcgggataggaagctgcggttgggccgtgcttaggcacgctgatgcagccggcgaacccggggtcatcgagggactgggctcctggtgttttgacgttcctgaaacatctaaggagcggattccaactaatcaggtgcgccgatcaaaccgtttgttaagaagggtaatccggcgcagaaggaatcggatggcggaaattcgccgactgttccatgctcaaggtctactcccgagtgccgatgaggacgcactgaaaagacccaggcttgatccttgggagctgcgggcccgtgggttggaccagtgcctcagcgctgaagagtttgcagtggccctgggacacatcgctcgccatagaggcttcaggtcctctgccaagcggaaagcggcaaacacgtcgggcgaagattcaaagatgctgagcgccctcttagtcacccgagagcgcacagctagatacaggactgtgggggagatgtttgcccgggacccagaatatagtgcacgcagaaggaatcgtgatggaatattcgaccggaccgttgctcgagatgacctgatccacgaggtgggtaaactttttgaagcccagagagcgaggggctccgccttcgcatctcccgatttggaggctgactttaacgccattgctttccgccaggccgaaatgcaagacagcgagcggctggtcgggaattgtccttttgagagagatgaaaagagggcagcccgctgggctccatccttcgagcgatttcggctactcacacgtctgatcaaccttagaattgcgaccgcagaaggagagaggcgcttcactcccgaagacctggcccgggtgtcagctgagttgggcgccacagcaaagctccctgtaagtagagttagggccctgatcggtttactgccagatgagcgattcaccacgatacgcgtggaagacgaggatcgggacattgtcgctagaactggggaagccgcaccgggaacctggaggctccgtaaaacacttggcgaggcgctgtgggctgaaatgcaggcccgccccgatcagttggacgcaatcgcccatgtgctgagctttttcgaggctactgccaagattcggtctgagctggatagactcggcctgcctgcagctgtgatcgaagcccttgacagggggctggaggatggagcgtttgccaaattcaagggtgctggccacatctccgcaaaagcctgccgaaatttgctcccacacctacagcaagggcatcggtacgaccaggcttgtcgcttagccggatatgaccacgcagcgtcaaccctgagccatacagcccaggtcgttagtaaggctggctttaacgccctagtgaccgaactcggtgagtctattgcaaatcccatagctagaaaggccctgacggaggggcttaaacagatcagggcaatgtgcgcccggtggggcttgcctggagctattcacatcgaactggcgcgagaggtaggcaactccatagaaaagagacgcgagctcgaaagccaaagggagactacaaccaaacgtcggcagactgagagagatgaaattagggggctgcttgccctggaggacgtggatgacgatacattgctccgctaccgactgtggaaggaacagggaggtaaatgtttatataccggcaaggacatccacgtcagacaactgatcgcaacggataattcggtgcaggttgaccatattctaccatggtctcggttcggggatgactcctttaacaataaaaccctctgcctggcttcagccaaccagaggaagcgcggacagacaccctgggagtggttcagtcttactggcaccccggaagcctgggaggtgtttgctagccgtgtcgagacatccaaggatttgagaggtttcaaaaagcggaacctgctcctgaaaaatgcagacgaagtggcccaaaggtttcgctctcgaaacttaaatgatactagatacgcggctcggctgcttgccgaggcagccaagttgttctatcctgctggggacaggcaggaaaaagacggccgcagaagggtactcacccggcccggaccactgacagcagccctacgtcacgcgtggggcctggagagcctcaagaaggctgatgggaaacgcgtttcagacgatcgacatcacgccctggacgcacttgccgtggctgccatcagtgaaagagaggtccagaggttgacccggtcctttcaggagtgggaacaacagggactggcacgccctttaagacatgtggctcccccatggcccggtttcaggggcgatgtcctcgccgcgtacgcccaggcattcgtggctcggcctgagcgaagacgcgccagggggaagggacacgacgctagcattcggcaggttgtgggcgaaggtccagaggcacaagtatttgagcgtagagggctggccgatcttaaagaagccgacctggatagggtcaaggacccggagcgcaaccaggctataatcgaagcggtgcgggcatggattttggccggccgacccgctgatgcccctccaagatctcccaggggagacgttatcgtgaaactccgcactgcccctgcaaagaagatcaaaccagctgtccccgtgcggggcgggacggcggatagaggagacatggtacgtattgacgtgttcacaaggccgaatcggaagggccgcgatgagtggtacctggttcctatatatccacaccaggtcatgaaccgaaaagcctggccccatcctcccatgagatcagtggtggcatacaaggacgaagctggttggaccgagatcggggccgagcacagttttaggttcagcctatatccacggtcctacgtccagctggttaaatctaatggagatgtgattgaaggctatctcgtgtcgatggaccgcagcactggtgcatttagagtattcgtccataacaatcctgccgagatggctaagggcatcggggccaagaccctgcttaacttgaggaaatttaatgtggatcgattcggagttcggacagaagtgaagtccgaggtccgtacctggcacggcgaagtgtgtacttcacccgttccaccggactga

SEQ ID NO: 2630 - RNA, 3150 nt, synthetic construct
  misc_feature 1..3150: note = Cas9 variant
  source 1..3150: mol_type = other RNA
atgcagctgagcaagctcaactacatccttggcctggacttggggattgcctccgtgggatggtctgtcatagagatcgatgaaaccgagatgcccattagattaatcgacgttggtgtgaggacattcgaacgggctgaggtacctaaaactggcgaatcactggcactagcccgccgactcgcgcgtagtacgagaaggctgattcggcgcagagcttttaggcttctgaaggccaaacggttgctcaagaatcaccaaatcgtgagcgcagatgagctgtccaccctgccaaaccattgctgggagctccgcgtcaaagggttagacgaacgactgacatgtcaggagtgggccgctgtgcttttgcatctgctaaagcacagaggatatctctctcagaggaagtcggaagcacagaatgccgataaagagatgggcgctctgctttcaggtgttgccaacaatcacaagctgttgagcgagaaccattaccggactccggcggaaatagcagtgaaaaagttcgccctcgaggaagggcacatgcgtaatcaacgcggagcttatacccacacatttaacagactggacttactggccgagatgaggctccttttccagacccagcgggaactgggcagtccctacgcatccggcgagttggagcaggaattttgcaaactactgatgtggcaaaagcctgctctctctggggatgccatcctgaagatgcttggaaaatgtactctggagccaacagaatataaggcggccaaaaatacctacacggcagagcgattcgtctggttgactaagctcaacaatctgcgcattttagaaaacggtagcgagagagctctgaatgccgacgagagggctctactcctgaaccagccctatgaaaaagccaagtttacctacgagcaggcacggaaacttttgcagctgaatgaagccgctcgcttcaactccgtgagatacggcaaggagaacgcggaaaagtcaacactcatggagatgaaagcatatcatgccatcaggaaggctgtagagactgccgatagtagcgcatgggccaccctgaaaacacaacctcttctgttggacgaaattgggaccgctttttctatctacaagacggatgaggacataaaaactcagctccagggaaagctggccgataatgttattgacgtgttactggaaaacctaaatttcgacaagtttatccaactctccctgaaagcactttataagattttgccactgatggagcagggcctccgttacgatgaggcgtgctcacagatctatggtgaccacttcgggaaaaaggaacagaaaaacgatcggctgttaccccaaatccctgctgacgagattcgaaatccagtcgtgctgagaacacttagccaggccaggaaggtgataaacgcagtcatccgcttgtacggaagtccggcccggattcatatcgaaaccgctagagagctcggcaagtcttataaagataggaaggaaatagagaaacgccaggagcagaatcgagccgaacgggagaaggcagttgacaaatttaaggaactgttccccaacttcattggcgagcctaaggctaaagatatcctaactatgcgtctgtacgaacaacagaatgggcagtgtctctactccggaaagagcctggaccttcacagattgctggagaaaggttatgtggagatcgatcacgccttaccattttcgaggacatgggacgattctttcaacaataaggtactcgtgctggcgggcgaaaaccagaataaatccaaccaaaccccctttgagtggcttgggaaggacgaacagaaatgggccctgttcacggctcgcgtcaattcatgccggtttccttacagtaagaagcagagaattttgaccaaaaagctcgacgatgagggattcatccagaggaacctgaacgacacacgatatattgcacgctttctagtgaatttcgttaacgataatctgcatctcactggcaaaggtaagcggagagtgtttgccagcaacgggcaaataaccgctttcctgaggggccgttggggacttacaaaagtccgcgaagagtccgaccggcaccatgccttggatgcagtggtagttgcgtgttctactgtgagcatccagcagaagattaccagatttgtcaagtaccaagagggcaatctgcagacagccgaaaggatcgaccgagagaccggggaaatcattccattacacttccccgatccgtgggcctttttccgggaggaggtgatgatacgcatcttctcagaaatgcctcaggaggacctcgtcattaaactgcccgatagaccacaggctaaccatgaatttgtgcaacctcttttcgttagtaggatgcccactcggaagatgtccggacagggtcacatggagacgatcaaaagcgcaaagcgactggacgaaggcatttctgtgtcaaaagtaccactaacacagctcaagctgaaggatttggagaatatggtcaacagagaccgcgagatcgctctgtatgaagccttaaaagcaaggctcaccgagtttaaggatgaccccgccaaggctttcgcggaacctttttacaagaaagggggagtgcaggttaagagtgtgcgtgtcgagcaagtgcagaaaagcggcgtagtggttcggaatggtaacggggtcgccgacaatgcatccatggtgagagtggatgtcttcataaaaggcggaaagtattttctggttccaatctacacttggcaagtggctaaaggcattcttccggacagggccgtgatcgcctacacccccgaaaacgagtgggagctgatggatgactctgctcagttccagttttcgatttatcctaatgatttgatcaagctcacaaccaaaaaggcaatattctttgggtactatagcggattcaaccgcctgactggtgccattaatatcaaagaacacgacctacagatttccaagggcgataagggggtacatctgggacttggcgtcaaactcgcgctgtcattggagaagtaccaggtggacgaactgggtaaaaacatccgaccatgcagacccacacaacggcagaacgttaggtga

SEQ ID NO: 2631 - RNA, 3153 nt, synthetic construct
  misc_feature 1..3153: note = Cas9 variant
  source 1..3153: mol_type = other RNA
atgagctcctacagattctcttttgacctgggcaccaactcaatcgggtgggccgtgttcgagctcgatcccaagacaaggcctgtcgctcttgcagactgcggagttcggatttttccagatggtcgcaatccgaaagacaagcagagtctggccgtggcgcgacgtgaagctagagccgtaaggcggcgcagagataggtatttgaaacggcgcagcgagttaatggaacgactggtggcaaagggcctaatgcccgagtccagagacgatcaaaaagccctcgaagggctggacccttacgctcttagggcagccggactggatgacgctttgccaccccaccatttcggccgggccctctttcacctgaaccagcgtcgcggtttcaagtctaatagaaagactgataggggagagaactcggagacggggataaccaaaatcggcatgaagaaactgcatgaagcgctcttatcagagggctgtcggacactgggggaacttcagcaccgacatcacgaggcaaatcagactcctgccatggacaccaacccaaagagcgtccgcagtaaattgagaggagagggtgctaaggccgtgtatgatttttacccctccagggacgcagttgaagacgagttcaataagctgtgggattctcaaaaacggtttcaccctgacctactcacagatagcgctcgcgacgccattagagatgcgatcttctatcagaggaagctgaaaaccccagacgccggccgttgctcctttaacccggcagaagaacgggtggctcgagccatgcccattgctcagcatttcagaatccttcagtttgtcggggatctgaggttgatagacaatgatctcgtgcgccaccctctgaacaatgaccaaaagaaagccttataccgggatctgctcgcaaagggaaaacttactttcaaggccatgagaaagacaatcggcattggttcagaatatgctttcagtcatgagagcgagaaacagtctgaatttcgcggggacgagaccgcggcaaggctggccggaccaaagtacttcggccccaaatggcgagaattgtcctttaacgaccagtcagagatcgtagatcggctactgcacgaagagaatgaggaaacgctcattcagtacctgcaagaccgtttcggctttgatcacgacagatgtgaggttatcgctgatgcccctcttccagacgggcatactaggctgggaaagaccgcattggaaacactcgtggagataatgcgcgatgaccatctgccctatgatcaggcctgcactaaagctggttacgaacacgccttaccgcctgacggcgtcattctggatgacctaccctattacgggatcgcactcgagcggcacgtggcgttcggagatggcaagagcgagaacccagaaaagagatatggtaaaattgctaatcctaccgtgcatatcgccctgaaccagcttaggaaggtcatcaacgcattgattgcccgatacgggcaccccgaccaagttgtgatggagatagctcgcgacctgaaacagagtaaggccaaacgggatgacatctctaaggaacagaagaaaaatcaggatagaaacgaccaaaggcgtaagaaactccaggaggcacacattgctgtaaatgccgagaacatgctgcgcatgcggctttgggaggagctggatgaagacaatgcggccgctagagcatgtccatttacaggcgagaccatctccatggccaggttgttcagccccgaagtggagatagagcatattctccctttttcgcgatctctggataactccccagctaataagacgttatgcatggtctgggccaaccgggcaaaaggaaatcgcactccgtgggaagcgttcggcagagacagggagcccgggtttgattggcctgaaatcgccgctcgggccgcacgactgccaaagaacaagtcatggagattcggacccgacgctatggagcgcctagaaagggagggtgattttctcgaccgtcagctgacagatacccagtatcttagtcggatcgccagagagtacgtgactaaaatttgtgaccctaatcaagtttgggtgacaccaggcaggttgaccgcatggctgcgccgaaactgggggctcaatggaatcctgcccacgggcaacgccaccaagaatagagacgatcaccggcatcacgctattgacgcgatagtcgtgggtttaacagatagggggatcctgaaccgcgtaagccgttccgccgcacttgctgaagccgaggacttggatagatctattgccgaaatgccggaccctttcgatggcttccgggacaacatcaggcacatcctcgagcagattatagttagccataaaccagatgctggatttgtgcccggccaccctaaggggaatactacccccggagcactgcataacgacacagcctacggtatcattaaaactgatgcgaagggcatgtcagaagtcgtgacccgcaaagacgtcctaagtttcaaggggacaaaggagatcgagtccattcgagacgctgccaccagacagagcctgctcgatgcagtggccggagttccatctggcctggcttttaaagaagcacttcgggactggtcagtgaggactggtacgaagcgcgtaagagtcacattcaatatgagtgtgatccctatacaggatagggacgggaaagcctataagggctacaaaggagatggcaacttgtgcgcggagatctatgaacggcccgacgggaagtggggagatgagattatcagccgttttgacgctgttcaaccaggcttcaccccgcagtggcagcgcgatcaccctgccgcacatcgagtgatgagactgtttagggacgatatgattatggccgagatcgacggtgtcatgactgtgtgtcggatagtaaagatgtcccccgggaaagtggttttcaccccacaccacgaagctaatacagattctcgcaacagagacaaggacgatcccttttcgttccatacctgcagcggagagtccttaaggaaacggaaggcccagaaactctttgtcgaccctctgggcaagattcgaggttacagagcaaaggaaggctga

SEQ ID NO: 2632 - RNA, 3153 nt, synthetic construct
  misc_feature 1..3153: note = Cas9 variant
  source 1..3153: mol_type = other RNA
atgggcgagaacatgatcgacgaaagcctgaccttcgggattgatctcggaataggttcctgcggctgggccgtgcttagaaggccctctgcttttgggcggaagggagtcatcgagggcatgggttcatggtgtttcgacgttcctgaaacaagtaaagagcgcactccaacgaatcagattcgacgtagcaacagactgttgaggcgggtgatccgcagaaggcggaatcgcatggcagccattcgaagattactgcacgcggctgggctactcccgtccaccgattctgacgccctgaagaggcccggacatgatccttgggaacttcgggcacgtggcctggacaaaccattgaagcccgtagagtttgccgtggtcctcggccacatcgctaaacgcagagggttcaagtcggcagccaagaggaaagctacaaacatatcaagcgatgacaagaaaatgctgactgccctggaggcgacccgggaacgactcggacgctacagaacagtgggtgagatgtttgcaagggatcctgacttcgccagtcggcgcagaaatagggaaggcaagtatgatcgtaccactgctcgggacgatttagagcatgaggttcacgccctgtttgcagctcaacgaagacttgggcagggattcgcctccccagaattggaggaagcgtttacagcctctgcattccatcagaggcccatgcaggacagcgagcgcctggtgggcttttgccctttcgaacggaccgagaaaagagctgccaagctaacgccatcctttgagaggttccgcctcctggctcgacttctgaacttgcggatcactaccccggacggtgaacgtcccctcacagtcgatgagattgccctggtgactagagacttagggaagaccgcaaaactgtcaatcaagagggtacgcacactcattggacttgaagataatcaacggttcaccacgatcagacctgaggacgaagatagggacatagttgcccgaactggcggcgctatgacagggaccgcgactctgcgcaaagcattgggagaggccctatggacagatatgcaggagcggccagaacagctggacgctattgtgcaggtcctcagctttttcgaggccaacgaaaccatcacggagaagctgagagaaattggtcttaccctggcagtgttggatgtgctcctgacagccttagacgctggcgtctttgccaaattcaagggggcagcgcacatcagcactaaagctgccaggaatctgctaccccacctcgagcaaggacgtcgctacgatgaggcatgtaccatggccggctatgaccatgctgcctctcggctgtcccaccatggtcagatcgttgcaaagacacagtttaacgctcttgtgactgaaattggggagtcaatagccaatcctatcgcgagaaaggccttgattgaaggcctgaaacagatctgggctatgaggaaccactggggactcccaggcagcatacacgtagagctggcacgagacgtggggaatagtattgagaagcggcgcgaaatcgagaaacatatcgaaaagaacaccgcccttagagctagggagcggcgagaagtccacgatctgttggacctcgaggatgtgaatggagacacactgttaagataccgcctgtggaaagagcaaggtggcaagtgcctatataccgggaaggccattcatatcaggcagattgcagcgactgataactctgttcaggtggaccacatactcccctggtcccgtttcggagatgacagctttaacaataaaacgctgtgtcttgcctcggctaaccaacagaagaaacggtctacaccgtacgaatggttgtccggccagaccggtgatgcctggaatgcattcgtccagagaatcgagactaacaaggaactgagggggtttaaaaagcgcaattatctcctgaagaacgctaaagaggccgaagagaagttccgatcaagaaatttaaacgacacccggtacgcagccaggctgtttgctgaggcggtgaaacttttgtacgccttcggcgaacgccaagagaagggaggcaatcgtagagtatttacacggcctggggcactcaccgctgccctgaggcaggcctggggagttgaaagtctgaaaaagcaggatggtaagcgcattaacgacgatcgacatcacgctctagacgcactcactgtggccgcggtcgacgaggctgaaatccagagactgacaaaaagtttccacgagtgggagcaacagggccttgggcggcccttgaggcgcgtggaaccaccttgggagtccttcagagccgatgtcgaagcaacgtatcccgaggtgtttgttgccaggccagagcggcgtcgcgctcgaggagaaggccatgcagccaccatcagacaggtgaaggagagggaatgcactcccattgtattcgagcggaaagcggtctctagcctgaaggaagctgacttagagcgcataaaagatggtgagagaaatgaagccatcgtggaggcaattaggtcatggatcgccacagggcggcctgctgacgccccaccgcgaagtcccagaggcgatattatcaccaagatacgcctcgcaacaactatcaaagctgccgttcctgtgaggggaggcaccgcggggcggggagaaatggtccgtgccgacgtgttttccaagccaaacagaaggggcaaggatgagtggtacctggtacccgtgtatcctcaccagattatgaatcgcaaagcatggccaaagcccccgatgcggagcatcgttgctaacaaagacgaagatgagtggacggaggtcggtcctgaacatcaattccgattttctctttacccaagatcaaatattgagatcataaggcccagtggggaagtgattgagggatatttcgtgggcctgcaccgcaacaccggtgccttgacaatcagcgctcacaacgaccctaagtccattcattctggcatcgggactaaaaccctcctggcaatatcgaagtaccaggtcgatcggtttggaagaaagagccccgttcgtaaagaagtgaggacatggcacggcgaggcctgtatctccccaactcctcccgggtga

SEQ ID NO: 2633 - RNA, 3153 nt, synthetic construct
  misc_feature 1..3153: note = Cas9 variant
  source 1..3153: mol_type = other RNA
atgaagatcctgggcttcgacattgggatagccagcatcggatgggcttttgtggagaacggtgaactcaaagattgcggcgtcagaattttcaccaaggcagagaatcccaaaacaggggactcccttgccatgcctaggcgggaagcgcgctctgttcgacgtagactggctaggcggaagggacgcttggagactttaaaaagactgctagccaaggaatgggatctctgttacgaggactatatcgcagccgatggcgagctgccaaaggcttttatgggtaaaaaccttaataacccgtacgtgctgaggtatgaagcattgcagcggctcctgtcaaaggaggaactggtacgcgtggtcctccacattgccaaacatcgagggtacggaaataagaacgctaaaatcacgaagagtgaggagagcaagagagaacaaggcaaaatattatccgccctggcgaccaatgcatctgccatcgctaggtatcggacagtgggcgagtacttctataaggaattttgcgaggttattaaaaacccccaggggctttcgactaatgaacactacacccagtcaaaggtgcgtgtcttgaaacctatccgcaacaagggaggtgagtacacaaattgtattctgcaggaggacctacaaagagaactcaggtgcatcttcgagtatcagaaaggctttgggttcccaataacccaggaatttcaggataagattctgaagatcgccttctaccaacggccccttaaagactttagccatctggtgggaaagtgtactttctatcctgatgagtttcgagcattgaaatgcagtctctccgctgtagagttcattacactgtctaagaccatcaacgttttaacgtacatcagcaaagaatccggcgaggtgtattcaaagggtcagtacgaacagatgctggacagtgtcttcaaggccgtgtgtgagaaagggagcctctcttttgcgcagcttcgcaagattctgcacatagatgaaagaatcaggttcaaagaggtggactatatggcccggaagtccaaaaatacttcaggagatagcacccataagcaaaagacaagtaacccagaaactaaaaagtttattgagcacaaaaatttgaagaaattctgcgagatcctatctgaaatagcagaggaccgcgctctggccgactccattgctagagatatgaccctcatcaaggacgaagagaagctggcccagaaacttcacggctacggcaagtttagccaggagcaaatcacacagctgtcggcattgaacttctctcatcacattaacctctccctgaaagccttatcagaaatcctgccctttatgagggaggggatgcgttacgatgaggcttgtaagctagcgggactcaaagcacggcataatgacaagaaaagtaagttcctgcctccattttgcgaaagcatttatgccgatgaacttaccaacccggtcgttcaccgagctatagccgagtacagaaagatcttgaatgcactgattgccaaatatggttccgtgcacaagatccatatcgagctcacgagggacgtaggcaaaaacttccaggaacgcgagaagtacaaaaaggaaattgagtctaattataaggctcgggtgcaggccatgcaagaatgtgagaaactggggcttactctgagcgagggaaacatattgaagctcagactgtttagggaacagaatgagatctgcgtctactcaggccgcaaaattacattagcaaacctgaaggaacagggtgcgctagagatcgatcacattctcccctatagtcgatccagcgacgattcttacatgaataaagtgctggttttcaccaacgaaaatcagaacaaggggaataagactccttacgaggcttttggcggagactcacaaaaatggggcgagatcgaaagtcttgccttgcggagcgggtatccaaagaaaaaggcaaaacgtatactggataagggattcggtgacagagaggccggcttcaagtccaggaacatcgtggactctgggtacattgctcgcctcatcgccaattatacaaaagaatacctgaagtttttacccctggattcgcatgagaacaccgcacttattgctggagagaaagacagcaagatccacgtcgaagccgtgaaaggcatgttgacggcgaccatgcggcatttctggggtctcgggtccaagaacagatatgagcacacacaccatgccgtagatgctataattatcgcatacattaatgccgctatgatccagaggttttcacagttccgacagaaccaagaaagtctgaaagcccgcttttatgcaaaggagctagcgaaggaagagttcaaaactcagcgggcctttttcgagccttttagaggcttcagggaacaggttctggctaaggtgggacagatatttgtctctcgtccaccccgcaaacgggccagaggcgcactccacgaggaaaccttctacagcatcgacgataagaaactgtccgagacatacgggggaaaggaaggtgtgcaaagggctctttcattgggcaagattcgacagatcgggactaaaattgtcgccaatggaccgatggtgcgggttgacatctttaagcataaacagagccgcagattctatgcagtgcctatatacaccatggatttcgccctgggcattttacccaacaaggctgtagtctctggtaaagacacaaagtccaaggtgatcaaagattggctcgagatggacagttgctatgagttttgtttcagcctgtttaaggatgaccttatcgaagttcaaaaatctgatatggagaagccagaactggcgtacttcgtgtccttggacgcctcagacgggaggattaaagtccggcaccactgcaatgatatcaccaagattaacgagaatcagaagaaactctttagtgaagcaatagagaaggaggtggtaggccgaggaagcatccagaacctgaaagtgttcaagaaatataaggtttcgcctctaggcgaaattaaggaggctaaatacgaacccagacagccaatcgccctgaagacttcccccaaaaagcatcgcaaacaaaataacgcccagtga

SEQ ID NO: 2634 - RNA, 3156 nt, synthetic construct
  misc_feature 1..3156: note = Cas9 variant
  source 1..3156: mol_type = other RNA
atgaacaattacatcctgggcctcgacattgggataaccagcgtgggatatggtatcgtcgattccgacacaagagagattaaggatgccggcgttaggcttttccccgaagctaacgtggacaataacgaggggcggcgctctaaacgaggagcacgtagactgaagaggcggcgcatccacagattggatagggtaaaacatttactggccgaatacgacctactcgatctgactaatattcctaagtcaacgaacccatatcagacccgggtgaaaggccttaatgagaagctgagtaaggacgaattggtcatcgcgctcctgcacatagctaaacgccgaggtatccataacgtgaatgttatgatggatgacaacgatagcgggaatgagctgtccacaaaggaccaactcaaaaagaacgccaaagcattatctgataagtacgtgtgcgagctgcagcttgaaagatttgagcaggactataaggtcaggggagagaaaaatcggttcaagactgaagactttgtgcgtgaggcccgcaaattgctggaaacccagtcgaagttctttgagattgatcaaacattcatcatgagatacattgaactaatcgagaccaggcgggaatattttgagggcccgggcaaagggtcacccttcggatgggagggtaacataaagaaatggtttgaacagatgatgggccactgtacttacttccctgaggaactccgaagcgtaaagtacagttattccgctgagctgtttaatgcacttaacgacctgaacaatttggttattacacgcgatgaagacgccaagctcaactacggggagaaattccagatcattgagaatgtgtttaagcagaaaaagaccccaaacctgaaacaaatcgctatcgaaattggagtccatgagacggaaataaagggctatagagtgaataagtctggtaaacccgagttcactcagttcaagttataccacgatctgaaaaacatctttaaggaccctaaatatctcaatgatattcagcttatggacaacatcgccgaaataattaccatctaccaggatgcggagagcatcattaaggagctgaatcaattgccagaactactgtccgagagggaaaaggagaaaatctcagcactcagtgggtatagcggaacacaccggctgtctcttaagtgcattaacctgttgctcgacgatctgtgggagtcctcattaaatcagatggaactgttcactaaactaaacctcaagcccaaaaagatagacctgagccagcaacataagatccctagtaaacttgtggacgattttattttgtctccagtcgttaagcgcgccttcatccagtccatccaggtggtaaatgctattatagacaaatacggcctgccggaggatatcattatcgaactcgccagagagaacaatagcgacgataggcgtaagtttctgaaccagcttcaaaaacagaacgaagagacccggaaacaggtggagaaagtcctgcgagaatacggcaatgacaacgcaaagagaattgtgcagaagatcaaattgcacaatatgcaagaggggaagtgtctctattcgctgaaagatatacccttagaagacctgctaaggaaccctcatcactacgaggttgatcacatcattccacgctctgtggctttcgacaattccatgcataacaaggtcctcgtgcgggccgatgaaaattcaaagaagggaaacagaacaccctatcagtacctgaatagtagcgagtcctctcttagctataacgagtttaagcagcacatcttgaatctgtcaaaaaccaaggacaggattacgaaaaagaaacgcgaatacctcctggaggaacgagatatcaacaagttcgacgtacagaaggagtttataaatcggaacttagttgacactcgttatgcgacaagagaactgaccagtcttttgaaagcctacttctccgcaaataacctcgatgtgaaggtcaaaactattaacggtagctttacaaattacctgaggaaggtgtggaaattcgacaaggatcgcaacaagggctataaacatcacgctgaggacgccctaatcattgctaatgccgattttctgttcaagcataacaaaaagctccggaatatcaacaaagtcctggacgcaccttctaaggaggtggataaaaagagagttaccgtgcaatcagaagacgagtacaatcagatattcgaagatacgcagaaggcccaggctatcaaaaagtttgagattaggaaattcagtcaccgagtagacaagaaaccaaaccgccaacttatcaatgataccttgtatagcacacggaacattgacgggatcgagtacgtcgtggaatccataaaggatatttattctgttaataacgacaaggtgaaaactaagtttaaaaaggacccccacagactgttaatgtacaggaatgatccgcagaccttcgagaaatttgaaaaggtcttcaagcagtatgagtcggagaaaaacccttttgcgaagtactacgaagagacaggagagaaaatccgtaagttcagcaaaactggccaaggtccctatatcaataagattaagtacctccgcgaacggctggggagacattgcgacgtgaccaacaaatatatcaactccaggaataagattgtacagcttaaaatatactcatatcgatttgatatctaccagtatggcaacaattacaagatgattacaatcagttacattgacctggaacagaaatctaactattactatatcagccgggagaagtacgaacaaaagaaaaaggataaacagatagacgattcctataagttcatcggatcattttacaaaaatgacattatcaactataatggcgagatgtaccgcgtgattggggttaacgatagcgagaagaataaaatccagttggacatgatagatatttctatcaaggactacatggaactcaacaatatcaagaaaaccggagtcatttataagactataggtaaatccacgacacacatcgagaagtacaccactgacattctgggcaacctatataaagcagccccacctaagaagccccagctgatcttcaaatga

SEQ ID NO: 2635 - RNA, 3159 nt, synthetic construct
  misc_feature 1..3159: note = Cas9 variant
  source 1..3159: mol_type = other RNA
atggagaacaagaatctgcactacatcctcggccttgacctggggattgccagcgtgggatgggctgtcgttgaaatagatgagaaagaaaaccccttgagattaatcgacgtgggtgtaaggaccttcgagcgggcagaaacacagaagggcgagtccctggccctatctcgccgatcagcgcgtagtgctagaaggctcactcaacggcgcgtggccagactgaaaaaggcaaaaaggcttcttaagagcgagaatattttgctctccacggatgaacggctgcctcatcaggtctggcagctgcgcgtggaggggctcgaccgaaagttagaaagacaggagtgggccgctgttctgcttcacttgatcaaacataggggatatctgtctcaacggaagaacgagtcgaaatcagaaaataaggagctaggcgcactcctgagcggtgtggccagtaaccacgaacttctgcagcaggctacctaccgtacaccagccgagttggcggtcaaaaagtttgaagtggaggaggggcatattcgcaatcagcaaggagcatatactcacaccttctccagactcgatctgttagccgaaatggagctgctcttttctaggcagcagcacttcggcaacccgtttgctagcgaaaagctgctggagaatttgacagccctactgatgtggcagaaacccgcactctccggcgaagacatcctgaagatgcttgggaaatgcaccttcgaggatgagtacaaggctgccaaaaacacttatacagcggaacggtttgtatggataaccaagctgaataacttgcgaatccaagagaatggactcgaacgcgccctgtcagacaacgagagattaatgctgattgaacagccttacgagaaagcaaagctaacgtatgctcaggttaggagtatcctcaatctgagcgatgacgccattttcaagggtgtgcggtactctggcgaggataaaaaggctatcgaaactaaaaccacacttatggagatgaaggcctaccatcaaatacgcaaagtcttggaagggaacaacctgaaggcagagtgggtggccctcaaggctaatccaactctgcttgacgagattggaaccgcgttttccctgtataaaacagatgaagacatctcagcatacttggccggcaagctcagccagcccgtgctgaacgctttactggagaatctaagtttcgacaaatttattcagctctctctgaaggccctttataaattgctgcctctcatgcagcaaggtctgagatacgatgaagcatgtagggagatctatggggaccactacggaaagaagaccgaagagacgcatcacttcttaccacagatccccgccgatgagattcgtaaccctgtcgttctgcggactcttacacaggctcgaaaagtgataaatggcgtagtgagattgtatggctccccagccaggatccacattgaaaccgggcgcgaggtcggaaagagctacaaagaccggcatgaactcaagaaaagacaggaggaaaacaggaagcaacgcgagaagactatctcggagataaaaacactgtttccgaatttctctggtgaacccaagggcaaagatattctaaagatgcgactgtactatcagcagaacgcaaaatgcctctactccgggaagcctctggagcttcaccggttgttcgaacagaaatatgtggaggttgaccatgcgctgccattatcacgtacctgggatgacagttttaataacaaggtgctcgtcctggctaatgaaaaccaaaataagggaaaccttacgcccttcgagtggctggatggcaaaaataacagcgagagatggaggacctttaaggccttggtggaaacatccgcattcccttacgccaaaaagcagcgcatcctctctcagaaactggacgagaagggttttatcgaacggaacctaaatgatactagatatgtagctaggttcctgtgtaactttattgccgacaatatgcacctcaccggggagggcaagcgaaaagttttcgcaagcaacggacagatcacagctctgcttcgccggagatggggcttggccaagtcaagggaggacaatgatcgtcatcacgcgctggacgccgtgttagtcgcttgcagtactgtggcaatgcaacagaaaattacccgctttgtccggttcaaggccggggatgtgtttacaggagaaagaatagacagggagaccggtgaaatcattccactccacttccccactccgtggcagtttttcaaacaagaggttgaaatccgaatcttctccgataaccctaagctggagcttgagaatcggctgcccgaccgcccacaggctaaccatgaatttgtgcagcctctattcgtaagcagaatgcccacgaggaagatgacaggccaggggcacatggagaccgtcaaatctgccaagcggctcaatgaaggaatttcaatgataaaaatgccactgactaagttgaaactgaaggatttagagctcatggtgaaccgagaaagagagaaggacctgtacgatgcacttaaaacccgcctggaggcgtttaatgacgatcccgccaaggctttcgccgaaccttttatgaaaaagggcggtgcaatcgttaaaagtgtgagggtcgagcaagtgcaaaagagcggggtattggtgcgtcagggcaacggagttgctgacaatgcctccatggtccgggtggatgtgttcacaaaagacggcaagtattttctcgtcccaatttacacctggcaggttgcaaaggggatcctgccgaacaaagccgtgattcagggaaaggacgaagaggattgggaagacatcgatgacgctactttccagttttctctacatcccaatgatctgatatcggtgaaaacaaagaaagacgagttccttggttactttaacggcctcaacagacacaccgggggaatcaatattaggacgcacgatctggaaaagagcaagggcaaacagggtatcttcgaggggattggcgtaaagatcgcgttgtcctttgagaaatatcagatagacgaactgggaaagaacattcgcttatgtaaaccttcaaagcgacaaccagtcagatga

SEQ ID NO: 2636 - RNA, 3159 nt, synthetic construct
  misc_feature 1..3159: note = Cas9 variant
  source 1..3159: mol_type = other RNA
atgaagaacaccagcctgaattacgtgctcggccttgacctggggatctcctctgtcggatgggccgttgtggagattgatgaaaaagagaaccccttgtcattaatagacgtaggtgtgagaacattcgaaagggctgagactcagaagggcgaaagtctggcactagcccggcgcctcgcgcgaagcgctcgtagactgacgcaaaggcgggtcgcccgccttaaaaaggcaaaaagactgttgaagtccgagaatatcctcctgtctaccgatgagtgcctgcctcaccaggtgtggcagctcagggttgaagggttagagcggaagctggaacgccaggagtgggccgctgtgcttttgcatctgattaaacaccgaggatatctatcgcaaagaaagaacgagtcaaaaagcgaaaataaggagctcggcgcactgcttagtggtgtcgccaacaatcataaactgttgcagcagacaacttacaggaccccagctgaactcgccgtgaagaagtttgaggtagaagaggggcacatccggaaccagcaaggatcctatacacataccttctctcgtctggacttactgagcgagatggaactcctgttttcccgccagcagcacttcggcaatccgtttacttcagagaaacttttggaaaacctaacagcgctgctcatgtggcagaagcccgcactgagtggcgatgccattcttaaaatgctggggaagtgtaccttcgagaatgaatacaaagctgccaagcacacgtatagcgcagagagatttatctggataactaaattgaacaatctcaggatccaagagaacggactggaacgggctttaaatgacaacgagcgactggccctaatgaagcagccttacgaaaaggcgaaactcacctatgcccaggttcgctctattctgaacctttccgatgaggcaatcttcaagggtttgagatactcaggcgaagacaaaaagacaagcgagactaaaaccgtgctgatggagatgaaggcttaccatcaaattaggctcgccctggaaaagaatgatcttaaaacagagtgggctgaactgaaggtcaacagttctttgctcgacgagatcgggaccgccttttccctgtataaaacggatgaggacataagcacttgcttagcaggaaagctgtcgcagccagtgctaaatgccctcctggaaaaccttaatttcgataaatttattcagttgtctctgaaggctctccacaagatcctgcccttaatgcagcaaggcctgcggtacgacgaggcgtgtgcagaaatttatggtgaccattacgggaaaaagacagaggaaaaccaccttttgctccctcagatcccagccgatgagatccgcaatcccgtggtcctgagaaccctaactcaggctaggaaagttattaacggagtggtacgtctgtattccagtcctgcccggatacacatcgagacaggccgagaagtgggcaagtcataccaggacagaagggagctcgaaaaacgccaagaggaaaatcggaagcagagagagaaggcaattagcgagatcaaaaccctgttcccaaacttttccggggaaccgaaggccaaagatatacttaagatgaggttgtattaccagcagaatgctaaatgcctgtactctggaaagcccttagagctccatcgcctgcttgaacaaggttatgtcgagattgaccacgccctgcctttcagccgaacgtgggatgactcattcaacaataaagtgttggttctcgcaaacgaaaatcagaacaagggcaacctgaccccatttgagtggctagatgggaagaataacagtgagcggtggaaagcgttcaaggctctggtggaaacatccgcctttccctacactaaaaagcagcgtatcctcagccagaaactggacgagaagggattcatcgaaagaaatcttaacgataccaggtatgtcgcacgctttttgtgtaatttcattgccgacaacatgcatctgacaggcgagggtaagcggaaagtgtttgcttctaatgggcaaatcactgccttactcagaggaaggtggggcctggcaaagtcacgagaggataacgaccgccaccatgctcttgacgccgtagttgtggcgtgcagtaccgtcagcatgcagcagaaaattacacggttcgtgagatttgaagagggcaatgtcttcaccggggaaaggatagatcgtgagactggagaaatcattcctctgcactttccagccccctggaagttctttcgcgaggaggtggaaatccggatcttctccgacaacccgaaactagagctcgaaaatagactgattgctaggcctcaagcaaaccacgagttcgttcagcccttgtttgtgtctcgaatgccaacgcggaagatgacaggtcagggccatatggaaaccataaagtcggccaaacgcctgaatgaggggttaagcgtaatcaagatgctcctgactaaacttagactgaaggatttggagtccatggtcaacagggaacgggagaaagaactctacgaggctctgaaggcccgactagaagcattcaatgacgagcctgcgaaggcctttgctgagcccttcatgaaaaagggaggcgccattgtgaaatcagttagagtggaacaggtccaaaagagtggtgtgctggtacgcgatgggaacggcgtggcagacaacgcttctatggttagggtcgatgtgtttaccaaaggaggcaagtatttccttgtgccaatctacacatggcaggtcgccaaagggattctccccaataaggcagttatccagggaaagaacgaggaagactgggaggtgatggatgacgccacctttcgtttcagcctgcaccagaatgatttggtgaaactggtaactaagaaaaagacaatatttggttatttcaacggcttaaatcgggctacggggaacatcgacattaaagagcatgatctcgaaaagtccaaggtcaaagacggaatccaccaatcaattggcatcaagctggcgcttagctttgagaaataccaggtggacgaactgggtaagaatataagattgtgtaaatcttccaagaggcaggccgttcgctga

SEQ ID NO: 2637 - RNA, 3159 nt, synthetic construct
  misc_feature 1..3159: note = Cas9 variant
  source 1..3159: mol_type = other RNA
atgatcggcgagcacgtgagagggggatgcctgttcgacgatcattggacccccaactggggtgcctttaggctccctaatacagtccggactttcacgaaggctgaaaacccaaaagacggcagctcccttgcagagccgcgccgacaggcccgtgggctgagaaggcggttgcgcagaaagacccaaaggttagaagatctgcggcgcctactcgcgaaagagggagttctgtctctttcagacctggaaacattgtttcgagagactcccgctaaggatccttaccagctcagagccgagggcctggacaggccactgagtttccccgaatgggtgcgggtactctatcacattaccaaacatcgtggttttcagagcaatcgcagaaaccctgtggaggatgggcaggaaaggtcccggcaagaggaggaaggaaagttactgtctggcgtcggcgagaatgaacgacttttgcgcgaagggggatacagaacagccggtgaaatgctggccagggacccaaagttccaggatcaccggcgcaacagagctggcgactattcgcataccctatcaaggagcctcctgcttgaggaggcacgtcggctgtttcagagtcagcgaactttggggaatccccacgcctcctctaacctcgaagaggctttcctgcacttagtggcctttcaaaatcctttcgcgagcggagaagatataagaaacaaagcaggccattgttccctggagccagaccagatcagggccccgcgccggtcagctagtgccgaaacatttatgctccttcagaagaccggtaatctgagattgattcacaggcgcacgggggaggagcgacccctaactgataaagaacgggagcagatccatctgctcgcatggaagcaagaaaaagttacccacaagacactgcgtagacaccttgagattcctgaagagtggctgttcactggattgccataccataggagcggcgacaaggctgaggaaaaactctttgtgcacctggccggcatccatgagatacgcaaggcgttagacaaagggcccgatcctgccgtctgggacaccctgcggtctagaagggatctactcgactccatcgcagatacactgaccttctataagaacgaagacgagattcttccacgattggagtcactgggactcagccccgaaaatgctcgcgccctggctccgcttagtttctctggtacggcccacctgtccttgagcgcactcggcaaactgttacctcatctggaggaagggaagtcgtacactcaggcccgggctgatgcgggatatgcagcacccccacctgacagacaccccaaactaccacccctcgaggaagctgattggaggaaccctgtggtatttcgtgccctgacacagacccgcaaggttgtgaatgcacttgtccggagatacggcccaccgtggtgcatccacttggagactgccagggagctgtctcaacccgctaaggtgcgacggcgcattgaaacagagcagcaggccaacgagaaaaagaaacagcaagcagagagagaatttctcgacatcgtgggtaccgcgcctgggccaggcgatctgttaaagatgaggctgtggcgggagcagggaggcttttgtccctactgcgaggaatatcttaaccctacgcgattggctgagccagggtacgccgaaatggaccatatactcccctattccagatcactggacaatggatggcacaaccgcgtcctagttcatggtaaagataatagggacaagggcaaccgtaccccgttcgaggcatttgggggagatacagcccggtgggacagactggtggcttgggtacaggccagtcacctcagcgcacctaagaaaaggaatctgcttcgcgaagatttcggcgaggaggctgaacgagagttgaaggacagaaacctgactgatacccggtttattacaaaaactgccgcgaccttactcagggaccgcctgacattccacccagaagcccccaaggatcctgtgatgacccttaatggtcgtctgactgctttcttgagaaaacagtgggggctccataagaaccggaagaatggcgacctgcaccatgcactagatgccgctgtcctggccgtggcatccaggtctttcgtttaccgcctcagctcacacaacgcggcctggggagagctgccccgaggcagagaggctgaaaatgggtttagtcttccatatcctgccttccggtccgaggtgttggcaaggctgtgtcccacgcgcgaagagatcttactcagactggaccaaggaggtgtcggctacgatgaggcttttaggaacgggcttcggccagtgttcgtaagccgtgccccgtctcgccgactgagaggaaaagcacatatggaaacactaaggtcacctaagtggaaagaccaccccgagggcccacggaccgccagtcgcattcccctcaaggacctgaatttggaaaaactggagagaatggttggtaaggatagggaccggaagttatatgaagctctccgagagagactggcggccttcgggggcaacggcaaaaaggcatttgtggctcctttccgcaaaccatgcaggagcggagaagggccccttgtccggtccctgcgtatctttgattctggatactcgggcgtggagttgagagacggtggggaggtctacgccgtggccgatcacgaaagcatggttagggtggacgtatatgctaagaaaaatcgcttctacctcgtccctgtgtatgttgcagatgtggcccggggaatcgtcaagaaccgagcgattgtggctcataaatccgaggaagagtgggacctggtagatggctcatttgacttcagatttagtctattcccgggtgatctggtggaaatagagaagaaggacggcgcctaccttgggtattacaaatcttgtcacaggggagatggccgcctcctgttggaccggcatgacagaatgccacgtgagagcgattgcgggactttttatgtttccaccaggaaggacgtcctgtcaatgagcaaataccaggtggatcccttaggagaaatccggctcgtgggctctgagaagcctccattcgtcctgtga

SEQ ID NO: 2638 - RNA, 3162 nt, synthetic construct; identical to SEQ ID NO: 2542
  misc_feature 1..3162: note = Cas9 variant
  source 1..3162: mol_type = other RNA

SEQ ID NO: 2639 - RNA, 3162 nt, synthetic construct
  misc_feature 1..3162: note = Cas9 variant
  source 1..3162: mol_type = other RNA
atgaagagaaactacatcctgggcctcgacattgggataaccagcgtgggatatggtatcattgattacgagacaaggaatgtcatcgacgccggcgttcggcttttcaaagaagctaacgtggagaataacgaagggcgccgatccaagcgtggaactagaaggctgaaacggcgcagaaggcaccggttgcagcgcgtaaagaaattactgtttgatcataatttcctaacggacaactctgagctctcaggcattagtccctatgaagcacgagtgaagggtctgaatcaaaagatcagcgaggaggaattttccgtcgcccttctgcacttggcgaaaagaaggggagtgcataacgttaatgaggtggaagaggataccgggaacgagctctctacaaaggaacagatatcgcgtaattcaaaagctctggaggaaaagtacgtcgccgagctgcagctcgaacggttaaaagtggacggcgaggtacgcggcgcagttaacagattcaagactagcgattatgtgaaggaggcccagcaaatcctgaaagtccagaaggcttaccaccagtttgaccagagtttcattgatacctatatcgaccttttggaaacaaggcggacctactacgaggggcctggagaaggttccccatttggctggaaagatattaaggagtggtatgaaatgctgatggggcaatgcacttacttcccggaggagctacgatctgtgaaatatgcatacaatgccgacctctataacgctctgaatgatcttaacaacctggtgatcgcccgcgacgaaaatgagaagttggaatactatgagaaatttcagataattgaaaacgtcttcaagcagaagaaaaagcccacactcaaacagatcgcgaaggagattctggttaatgaggaagacatcaaaggatacagagtgaccagcacgggcaagcctgagtttactaacttcaaggtataccatgatatcaaatccattacctcaaggaaggaaatattagagaatgcagagctgctcaaccaaatcgccaaaattcttacaatctatcagagtagcgaagacatacagggtgagctggctcggttgtactctgaactaactcaagaggaaattgagcagatctccaagctggccgggtataccggaacacaccgcctctcactgaaagcaatcaatcttattatcgatgagctgtggcacaccagcgacaaccagatggaaatttttaatagattgaagctcgtgccaaagaaagtcgatctgagtcagcaaaaggagatacccacgactttagtggacgatttcatcctgtctcctgttgtgaaaaggtccttcattcagagcatcaaggtcatcaacgctattataaagaagtacggctttccaaatgacatcattatcgaactagcccgtgagaagaactcgaaagatgcgcagaagttcattaatgaaatgcagaaacggaaccgacaaacaaatgagagaatcgaggaaataatcaggaccactggcaaggagaacgccaaatatctcattgaaaagatcaaactgcatgacatgcaggaggggaagtgtctttactctttggaagcaattcccctggaggatctcctgaacaatccttttaactatgaggtggaccacatcataccacgctccgtatcattcgacaatagttttaacaataaggttcttgtgaaacaggaagagaacagcaagaaaggaaatcggacaccgttccagtacttttcctctagcgattcaaagattagttacgaaatcttcaaaaagcatattctgaacttggctaagggtaaaggcagaatctccaagaaaaagaaagagtatctcctggaggaaagggacataaatcgctttagcgtccaaaagtacttcatcaaccgaaatttagtggatacccggtatgccacgcgtgagctgatgaacctactcagatcttactttagggtcaatgacctggatattaaggtgaaatcaatcaacgggggattcaccagttttcttcgcaagaaatggaagttcaaaaaggaacggaataagggctataaacaccacgctgaggacgccttgattatcgcaaacgccgatttcatatttaaggaatggaaaaagctggacaaaacaaacaaggttatggaggatcagattgtggaggaacagcaggctgagagcatgcccgaaatcgagactgaacaagagtacaaagagatcttcattacccctcatcagatccaggacattaaggattttaaggactataaatactcccacagagtagataagaaaccaaatagggaactcgtcaacgacacactgtactctactcgaaaggacgataaaggtaataccttaatagtgaacaatctgaaggggctttatgacaaggataacgacaaattgaagaaactcatcaataagtcgcccgagaaactgctaatgtaccatcacgatcctcaaacatatcagaagctgaaggttattatggaacagtacagcaacgagaaaaatccactctataagtaccatgaagagaccggcaactatctgactaaatactccaagaaagacaatggacccgtgatcaagaagattaaatactatggcaacaaacttaatgtctacttggatatcacgcgcgactatctgaaatcacggaacaagatagtgaaattaagtctcaagccgtacagattcgatgtatatctggacaatggggtgtacaagtttgttacagtcaaaaaccttgatatcattaagaaagaggactattacgaagtggattctgacagctacgaggaagcgaagatcgtgaaaaaggtctccgagcaggcacaattcgttgcctcattttataacaatgacctgattaaagtggatggagagttgttcagggtgatcggtgtaaacaatgacctcctgaaccgtatagaagtcaatatggtggatattacctacaaggagtatctagaaaacatcaatgacaagaaaagctctcgcatcattaagactatatccagtaaaacccagagcatcaagaaatactctacagatattctgggcaacctctatgaggctaagtccaagcagcggcctcagatgaccatgaaagggtga

SEQ ID NO: 2640 - RNA, 3162 nt, synthetic construct
  misc_feature 1..3162: note = Cas9 variant
  source 1..3162: mol_type = other RNA
atgaagagaaactacatcctgggcctcgacattgggataaccagcgtgggatatggtatcattgattacgagacaagggacgtcatcgatgccggcgttcggcttttcaaagaagctaatgtggagaacaatgaagggcgccgatccaagcgtggagcaggcagactgaaaaggcggcgcagacacaggttgcagcgggtaaagaaattactgtttgactataacctactcactgatcattctgagctgtcaggtattaatccctacgaagcccgcgtgaaggggcttagtcaaaagctgagcgaggaggagttctccgcggctttgctccacctggccaaacgaagaggagtccataacgtgaatgaagttgaagaggacacgggcaacgagctgtctaccaaggaacagatctcgaggaatagtaaagcactcgaggaaaagtatgtggccgagttacagctggaacggcttaaaacagatggcgaggtccgtgggagcataaaccgctttaagacttcagactacgtgaaggaggctaaacagttgctgaaggtacaaaaagaatatcaccagctagatcagtccttcatcgacacctacattgatctcctggagacaagaaggacctactatgaaggacctggtgagggctctccatttgggtggaaggacatcaaagaatggtacgagatgcttatgggacattgcacttatttcccggaggaactgcggagcgttaagtacgcatataatgccgatttgtacaacgctctcaatgacctgaacaatttagtgattgcccgagacgagaacgaaaaactggagtattacgaaaagtttcagatcatagagaacgtcttcaagcaaaagaagaaacccacactcaagcagattgagaaagaaatccttgtgaatgaggaagatattaagggctaccgcgtgacctccacgggtaagcctgagttttcaaacctgaaagtctatcacgacatcaaggatatcactgcgagaaaagagattatagaaaatgcagagttgctagaccagatcgccgaaattctgaccatctaccagagtagcgaggatatacaagaggaactcgttaagctgaactctgagcttacacaggaagagattgaacagatctccaatctgaaagggtatactggaacccacaacttgtcactcaaggctatcaatctgattttagacgagctgtggcatacaaacgataatcaaatggccatcttcaacaggctaaagctcgtgcccaaaaaggtagacctgagccagcagaaagaaattccaaccacgcttgtggatgactttatattgagtcctgtcgtgaagcggtctttcatccagtccattaaagttatcaatgcaatcattaagaagtacggcctgccaaacgatataatcattgagctcgctcgcgagaaaaatagcaaggacgcccagaaaatgatcaacgaaatgcaaaagagaaataggcagactaacgagcgtattgaagagatcatacggacaaccggcaaagaaaacgcgaagtatctgatcgagaaaattaaacttcacgacatgcaggaggggaagtgtctgtactcgttggaagccatccccctcgaggatctgttaaataacccttttaattatgaagtggaccatattatcccacgatctgtctccttcgataactcattcaataacaaagtgctggtaaagcaagaggagaatagtaaaaagggaaacagaactccgtttcagtacctaagctcctctgacagcaaaatatcatacgaaacattcaagaagcacattctcaatctggcaaaaggtaagggcaggatcagtaaaaccaagaaagagtatcttttggaggaacgcgatattaaccggttttccgttcagaaggacttcatcaatagaaacctggtggatacgaggtacgctacccgcgaactcatgaatctgttacgaagctattttcgggtcaacaatctggacgtgaaggtcaaatctataaacgggggattcacatcatttcttcgtagaaagtggaaattcaagaaagagaggaacaagggctacaagcaccatgccgaggatgctttgatcattgccaatgcagactttatcttcaaagaatggaagaaactcgataaggccaaaaaggtgatggagaaccagactgttgaagagaaacaagctgaaagtatgagcgagattgagaccgaacaggagtataaggaaatctttataacaccccaccagattcagcatatcaaggacttcaaagattacaagtattcccaccgcgtggacaaaaagcctaatcgggagctgatcaacgacactctatactctaccagaaaagatgacaagggtaatacactgattgtaaacaatctcaacgggctgtaccataaggataatgacaaacttaagaaattgatgaacaagtcgccagaaaaactgttaatgtatcaccacgatccccaaacctaccagaagctcaagctgatcatggagcagtatggcgacgagaaaaatcctctttacaagtattacgaagagactggaaactatctgacgaaatacagcaagaaagataatggcccagtcattaagaagataaaatactatgggaacaagttgaatgcgcatctcgacatcacagatgactaccccaactccaggaacaaagtggttaagctgtcactaaaaccgtatcgatttgatgtgtacctggacaatggagtctataagttcgtgaccgtaaagaacctcaatgtgattaaaaaggaaaactactatgaggttaatagtaaatgctacgagaaggccaaaaagctgaaaaagatctctgatcaagcagagttcattgctagcttttacaacaatgaccttatcaagatagacggtgaattgtatcgcgtcatcggcgtgaacactgatctgattaatcggatcgaagtgaacatggtcgacattacctacagagagtatttagaaaatatgaacgataaaaggtcccctcgtatcttcaagacaatagcctcaaaaacccagagcattaagaaatactctactgacatcctcgggacactgtatgaggttaattccaagaagcacccccagatgatcatgaaaggatga

SEQ ID NO: 2641 - RNA, 3162 nt, synthetic construct
  misc_feature 1..3162: note = Cas9 variant
  source 1..3162: mol_type = other RNA
atgagcggcatggtgttcgggatcgacctgggaattgcctcctgcggttgggctgtcctcagacagccccaaagggatggcgaccctggggagatagttgatcttggatcttggatgtttgacgtgccagaaaccgataaggagcggacaccgactaaccaggtacgccgaggcaatcgtctgttgagaagggtgatccggcgcagagcacagaggatggtcgaaattcggcgcttattccacgaccatggtctgctagccgggcacgcgcccgaggctctcaaacgagccggactggatccttgggaccttagagcaaggtcactggataaggtgttggaaccagccgctctcgcagttgccctgggccatatcgctaaacggcgtggctttaagagtgccgcgcgcagaaaagaggcaaacacggccggggacgatcagaagatgctgaaggctctcgaggccacccacgaaaggttaggacggtaccgaacaattggtgagatgttcgcacgcgaccccgattttgaaagcagaaaaaggaatcgggacggcatgttcgaccgcactcaagggagagatgacctgcttcatgaggtgggagagatctttaaggctcagaggcgtttgggctccgccctggcgaccgccgaactagagcaggcattcacagctatagcctttcggcagctccctatccaagattctgaacgactggtcggtctttgtcagttcgagccaaaagaaaagagagctgccaggtttgcaccctcgttcgagcgctttcggctgttgcagagactcaccaacctgagggtggtaactgttgagggggaacgccctttaacagccgacgagattgctgcggcagccgctgatctgggacgaaccgccaaactctcagtgaaggaagtccggaagcgtatcggccttgcagccgaccacagattcgctgccttcaaagcagatgaggaagacagggatattatcgcgcgcacgggcgaggctctgcacgggacttatcggttgagaaaggccctaggagagggtctgtgggcagaaatgctcccaggccagctggacgccatagctcatgcccttagctttttcgagacccaagatgtgattctgaaagaattggacaagctcgacctgccggcaggggtgagggatgctatcgccacaggattagacgcgggcgcctttgctcgattcaaaggtactgggcacattagtgcacgcgccgctcgggccctgctaccccatctcgaggcaggcctgagatacgatcaggcgtgcaccaaggccggatatgaccacgctgcctccaggtgggcaaaacgtgaacaggtcgctgataaggccgcatttaatcgccttgttacagacatgggcgccgagatcgctaaccctatcgcgcggaagtctttgaccgaggccctgaaacaactctgggcaatgagaaataggtgggggctgccagatgctattcacatagaacttgcccgagacgtgggaaacagcctggagaagcggcgcgaaatcgagagagccattgagaaaaatacggctgcaagggaacgggagcgaggtgaagccagagatttgctcggcatcgacgatgtatccggggacactctgttacgctacaggctgtggaaggagcaggcgggacgttgtccctatacagatgctcctataccacccggcgccattatcgcaaccgacaactcattccaggtggaccatatcctaccgtggagtcggtttggtgatgacagcttcgccaataaagtcctctgcgctactgcagccaaccagagaaagaaggggcaaacaccttgtgaatggattaccgcggctcagggcgaggagggatgggccacgtttgtggcaaggatcgaaggcaatgccgctttccgcgggcccaaaaagcgaaactacgttctgaaaaatgccaaggaggcagaagagagatttcgggctaggaaccttaacgatacccgctatgccgcgcgtttgctggccgaagcagtgaaactcttctacccagagggagagagacaggacaagggtggcgtccggagggtgtttacacgccctgggggactgactgctgccttacgacacgcttggggcgtagaagcactgaagaaaagagatggtaagcgggttgacgatgccaggcatcacgcccttgacgctttggtggtcgcggcaattggggagggcgaagtgcagcgcctcaccagatcttaccaagagtgggaacagcagggactggccaggcccctacggcgtgtcgatccaccctggggcgacttccattccttccgccgagaggtgaaagatgcttatgacgggatatttgttgccagacctgagaggcggcgcgcaagaggagaaggccacgccgctacaatcaggcaagtgcgggagcgagatggtgcggccgtagtcttcgaaagaaaggcaattgctgacctgtcagagaaacgcctcgccgacatcaaggatccagagaggaatcaggcaatcgtggaagccattcggcagtggatagttgacgggcgtccggctgatagactgcccaggagccctgccggagacgagatccgcaaggtgcggcttcgaactaaaggcaagccagcggtccaggtgagaggtggcgcagccgatcgcggggaaattgtaagggtggacgtttttaccaaacccaacaagaaaggaaagaatgagttctacttggtccctatctatccacaccaggtgatgaacaaagctgaatggcccacaccgcctatgcgggccgtggtcgcttacaaggatgagagtgagtggaccctgttagacgaaaattttggcttcctcttttctctgttcccaagatcctatgttgaggtgactaagcccgggggagaagtgcttagcggctactttcaaggtatggatcgttcgacgggggcaatttctctgttcaaccatagggactcccggtcattgacagatgacagtggaaatagcacccgcggcatcggtgccaaaactctcctgaccatgaagaaatattccgtagaccgatttggcaagagagctgaggtcaaatctgaagtgaggacatggcacggggttgcctgcacctaccctactcccccaggatga

SEQ ID NO: 2642 - RNA, 3165 nt, synthetic construct
  misc_feature 1..3165: note = Cas9 variant
  source 1..3165: mol_type = other RNA
atgaagctgacacccctcaactacatccttggcctggacttggggattgccagcgtgggatgggctgtcgttgagatagatgaacaggagaatcctttaggtctgatcgacgtgggcgtaagaaccttcgatagggcagaagtggccaaaactggggagtccctagcgctcgctcggcgcctggcccgatcttcacgtagacttgtcaagaggcgggcagaccgcattaaaaaggtgaaaagactgttgaagagtgaaaacatcctcctgagcgccgatgagcaactgccaaatgacgtttggcagctcagggtgaagggattagatcagaaactggagcggcaggaatgggctgcagtccttttgcatctgctaaagcaccgcggctatctctcccaacgaaagaacgagtctaaatcggaaaataaagagctgggtgcccttagatcaggggtggctgccaaccaccagattctgcagagcgcggagtacaggacgccggcagaaatcgccgtaaagaagtttcatgttgaggaaggacacatacggaatcagcgtggcgcttatacccatacattcagtcgcttggacctcctggccgagatcgaattactgtttactagacaaaccgagctcggcaacccccacacatccgcaaaacttctggagaatttgaccgctctactgatgtggcagaagcctgccctcgcgggggaagccattctgaaaatgcttggaaagtgcactttcgagccaacagaatacaaagcagctaagaactcttatagcgccgagaggtttgtgtggctgaccaaattgaataacctccggatcctggaacagggtgctgagcgagccttaacggataatgagcgcttcgcactgctagaccagccctacgaaaaggccaagtttacttatgctcaagcgagaaccatgctcgcactgcctgatgaggccattttcaaaggcgtcaggtaccagggggaagacaagaaagctgtggagacaaagactatccttatggaaatgaaagcctaccaccagatacggaaggcattggagaacgccgatctgaaggctgagtggaatgaactcaaaaacaactccgagctgcttgacgacattggaaccgccttttcactgcataagacagatgaagacatctgtcgctatttggatggcaaactcagtgagagcattctgaatgcattactggagaacctaaatttcgacaagtttatccaactctctctgaaagcgcttcagcagatcttgccactgatgctccagggtcaaagatacgatgaagctgtgtccgccatttatggggaccactacggaaagaagtcagcagagataaacaggctgttacccaccatccctgccgatgaaattcgtaatccagtcgttctgcggacgcttactcaggctcgaaaagtgatcaacgccgtagtgagattgtatggcagcccggcaaggatacatattgagacaggccgcgaagtcgggaagagttaccaggaccggaaaaagctcgagaaacagcaagaggataatagaaagcacagggaatctgctgtgcagaagttcaaagagtattttcccaacttcgttggagaacctaagggtaaagacatcctgaagatgcgcctatacgagctgcagcaggccaaatgcctctactccggcaagagcctggaacttcaccgattgctggagaaagggtatgtggaggtcgatcatgcgttaccattctcgcggacctgggacgactcttttaataacaaggtgctcgtactggccaatgaaaaccaaaataagggaaaccttactccctacgagtggctggatggcaaaaataactccgaaccttggcagaacttcgttgctcgtgtgcagacatcaggttttagtcacaccaagaaacagagaatcttgagccataagctcgacgagaaagggttcattgaaaggaatctgaacgatacgcgctatgtcgtgcggtttctatgtaatttcatcgcagacaacatgctgctcaccggcaagggaaagagaaaagtctttgcctccaatggccaaattacagctctgcttagggggcgatggggattgcagaaggtgcgcgatgacaacgatcggcaccatgccctggacgcagttgtggtagcgtgctctactgtcgccatgcagcagaaaataaccagattcgtgaggtacgaggagggtaatgtttttagcggcgaacgtatcgatcgcgagacaggggaaattatcccattacacttcccctcaccgtgggcctttttccgggagaacgtggagatcagaatttttagtgaaaatcctaagctcgagctggaaaacaggcttcccgactatccacaatacaatcacgagttcgtccagcctctgttcgtgtcccgaatgcccactcggaaaatgaccggacagggccatatggaaacagtaaagagcgctaagcgcctagatgagggtctctctgtgctgaaagttccattgacccaactgaagttaaacgacctcgagagaatggtcaatagggaacgggagatggcactgtatgaatcacttaaagtgcgactggagcagtttgataacgaccccgctaaggccttcgcagaacctttttacaaaaagggcggggccttggtgaaggctgtcagagttgagcagactcagaaaagtggagtgctcgtgcgcgacggcaatggggtagcggataacgccagcatggtcagggtggacgttttcacgaaggcaggaaaatactttctggtgccaatatatacatggcaagtcgctaagggtatcctaccgaacaaagccgtgaccgccaatgttgatgagattgactggctggaaatggatgagtcctaccagttcatctttactatgtatcccaacgaccttgtgaaggtaaaactcaagaaggaagagttctttggctactatgggggactggatcgtgctaccggcgcaattgtcatcaaagaacacgacttggagaagtctaaaggtcggcaggggatatacagaatcggcgtgaagctggccttatcgttcgagaaatatcaggtggatgaactcggaaagaatattaggccttgtcgcccaacaaagcgacaacatgtcagatga

SEQ ID NO: 2643 - RNA, 3165 nt, synthetic construct
  misc_feature 1..3165: note = Cas9 variant
  source 1..3165: mol_type = other RNA
atgagaatcctgggcgtggacctcggggtcgccagcgttggatgggctcttgtgaacgataagaataacaaaattatagactccggtgtaaggatcttcacccagtctacaaatcgggagggcaagactctggcagccgtgcgccgatcatttcgtgggggaagaagggtcttgagtcggcgcaaacaaagattaaaccagctgaagaaactattcattgcgcacaagctcctgagcaagtccgaatttaaacatcttttcaattctaagaacaggctggatatctggcagttgcgggctaaaggcctcgagcagcaactgaataacaaggaatgggcccgcgtgctgtaccacattgcaaaaagacgagcctatcagtcgaataggaagtcagaggaaagcggtaacacggacaagaaaaaggttctcagtgggatctccaaaaatgagaagaaaatgaacgagttaggatacaagaccataggcgaaatgctgtatacagagaatcggtaccccgataaccgtatccgcagaaataaaaaggaccagtataagcattctattagcagggatcttttgcggaaagaaatcgacgtgctgtttgagtcccagcgagatttcggcaaccaatttgctactgacgggctaaaggagcactacaaagatattgcattcacccagcgccctatcaagtttaaagccgacctcgtcggaaagtgcacattcgaaacccaggagtatagaggtgctaagaactgtttttcagtggaaaagagtactctgcttagcaagataaataacacagatctgattgacaaatctaccggcgagatcaagaggttgttcgaaatttccgagtttgacaaactcctggatatcttctactcaatcaaggaggtaaagtacacgactttacggaaacagctgaagattaccgacgccttcaaatttaagcaactcgattatcatcagaatttcgaatacaaaacaaacataaaggcgaagatcgaggacttttataaacttgaagattggctgactccagagcagaaggttttgctagaaaaacaagtgctggacgataagaaagagaagttcaaatgctacaagtatagcagtattcgctctatcctctccctgagcgagtcgcagaagtttaatggggtcaaatacgacaccaaggtggaaaacacagtgttcggaaaacttaatggctatcactctataaagaaagagctgaacaaggaagtctttgatttgctgttcattgacaaggataaatttaataagatcgcagagatcctgtcctaccagaaagacgacaagtcagccacccaggatttaaagaagcaagttttcaacgactttaatatggataagacgattgtgaacgaagctatcaatagtctgctaaacattagcttctccggttttaattctctcagcctgaaagccataaacaaacttttgccgtacctgtgtcaggggctcaaatatcacgacgcagtagctcattcagagtacaagcaccatagtcagttcaaagccgcgaacccccagcaatatctgagacctcttaataaggaggaaaactaccagatcacttccccaacagtgaagagggtcttcagccagtttcgtaaagtgctgaatgccgttattcggaagcacggatctttcgatgcaatgcacatcgagatggctcgagaattgaaaaactcaaagaaaatcaagtttgagattcagaccggccaaaaagagtatgcccaggaaaaggaggctataagagtgaagttcctcgaaatctttaaatacgagggcagtgggagggacctgttaaagctgcgcctatatgaacagcagcatggaaaatgcatttacagcaagaaagagatcgagattaataagctcctggaagatggttacgtcgagatcgaccacatacttccctggtcccggactttcgataactctttgaataacaaggccctgtgtctctcggcagaaaatcaaaacaaagccaatcagacaccttttgagtatctgaccaacagcgacaaaaattccaaagattcaaaggaatggcaggagtacaaaaactatgtgagttctttcgctggcatcaagcaagcgaagaaacataagttactgaatacgacccttccacccagaagggggaacgactttagcgatgacattaaaaaccctgagtccggattcttggcacgcaatctcaacgacacagcctacgcttcacgatttatcaagaatttcgtacagaaccacctccagtttagccagaatgatactattaaacaaaaggttaaggtgcggtctggcgccctaaccaaccagctgcgttataattggggtatcgaagagaaaaacagagacaataacctccatcacgcagaagatgccataattctggctttcgccacacagggggaggtccagaggatgtccactatcagtgcaaagcgcgaagacttcaaataccaaaccgcgaaggagcggaaaattaagtttacaccaccgttcagcgattttaagtctgtgcttgacgagtccgtcggcgatatcttcgtgtcatttgctcccagaaggaaaataagtggagccgcacacaaggccaccatcaaacctaaggacactggcgggaaatataagttcccagttaataacggaatggctgaaaatggtgtgattcagcgagtagatgtctttaaaaacgccaagaataagtaccagttcatcgtgttttaccccgcagacttctataaagatgactttcctgagttggatctgaagggcaacgaaattgacaaaaacgttcagttcttattcagcctctttaaggacgatctgatcgagttcaaaacgaagaagacaaaaaccaaggactcgaaacatcttctggcttactttaagtatatacgctccgatgggaaaattgccttccaacagaattacaaggcggagatcgaacggaaggagtctgacaacaaaaagggatataaagatatcttgctcgccactggcagcggtctggcttcactaaagaaataccaggtgagtgtcctgggggacattgcagaagtgaagaatgagaagagactcccactgatcaaacaaatgtataagtccaaacccaagaaaaagtga

SEQ ID NO: 2644 - RNA, 3165 nt, synthetic construct
  misc_feature 1..3165: note = Cas9 variant
  source 1..3165: mol_type = other RNA
atgaaccagaagttcatcctgggcctcgacattgggataaccagcgtgggatacggtcttatcgattatgagacaaagaatattatcgacgcaggcgtcagactgtttcccgaagctaacgttgagaataacgaagggaggcggtccaagcgcggatctcgacgtttgaaaagaaggcggattcaccgcttagagagagtgaagaaactgctagaagattacaatctcctggaccaatcacagatccctcagagtactaacccatatgcaataagggtaaagggccttagcgaggccctgtccaaggatgagttggtgatcgcgctcctgcatattgctaaacggcgcggtatccacaagattgacgtcatcgattctaatgacgatgtggggaacgaactgtcgacgaaagagcagctcaataagaactcaaaattactgaaggacaagttcgtttgccaaatacagcttgaacgaatgaatgagggacaggtgagaggcgagaaaaacaggtttaagaccgccgatattatcaaagaaattatccagttgctgaatgtccaaaagaacttccatcagctagacgagaattttatcaacaaatacattgaactcgtggagatgcggcgtgaatatttcgagggcccggggaagggaagcccctacggttgggagggcgatcctaaagcatggtatgaaacactgatggggcactgtacttactttccagacgagcttcgcagtgtaaagtacgcctattccgctgacctgttcaacgcattgaatgatctcaacaatctggttatacagagagacggattatctaagctggaataccatgagaaatatcacatcattgaaaacgtgtttaagcagaaaaagaaacccaccctcaagcaaatcgccaatgagataaacgtcaatcctgaggatattaagggctacaggatcacaaaaagcggtaagccacagttcaccgaatttaaactttatcacgacctgaagtccgtgttgttcgatcagtcaatcctagagaacgaagacgtgctggatcaaattgctgagatcctcactatttaccaggacaaagatagtataaagagcaagctgacagaacttgacatcctgttgaatgaggaggataaagaaaacattgcccagctcaccgggtatacgggaactcatcggctgtctttaaagtgcatccgactggtcctagaggaacagtggtactcctcacgcaatcaaatggagatctttacccacctcaacattaaacccaagaaaataaatctgacagcggcaaacaagatccctaaggccatgattgacgagttcatccttagcccagttgtgaaaagaactttcggccaggctattaatttgatcaacaagataatcgaaaaatacggcgtaccggaggacattatcattgaactggccagggagaacaatagtaaggataaacagaagtttatcaacgaaatgcagaaaaagaatgagaacacccggaagcgcataaatgagattatcgggaaatatggaaaccaaaatgcaaagagactcgtggaaaagattaggctgcatgacgagcaggaaggtaagtgtctttactctctggagtccatccccttggaagatctcctgaacaatcctaaccactatgaggtcgaccacataatcccacgtagcgtgtcgttcgataattcttaccataacaaagttttagtgaagcagtccgaaaattcaaagaaaagtaacctgacaccctatcagtactttaatagcggcaagtccaaactatcttataaccaattcaagcagcacattctcaacctgagcaaatcacaggaccggatcagtaagaagaaaaaggaataccttttggaggaacgagatattaataaatttgaggtccagaaggagttcatcaacagaaatctggtggacaccaggtacgctacgcgcgagctcactaactatctgaaagcctacttttccgcgaataacatgaatgtaaaggttaagacaataaacgggagcttcaccgattatttacggaaagtgtggaagtttaaaaaggagagaaatcatggatacaaacaccatgccgaagacgcactgattatcgctaacgccgatttcctttttaaggagaataaaaagttgaaggctgtcaactctgtgctcgaaaaacctgagatcgagtcaaagcaactggacattcaggtcgatagtgaagacaattatagcgagatgttcatcattccaaaacaggtgcaagacataaaggattttaggaacttcaaatactcccaccgcgttgacaagaagcccaatcgacagctaatcaacgatactctgtattctacacggaaaaaggacaactcgacctacattgtgcagacgatcaaagatatttacgccaaggacaataccacactcaaaaagcagttcgataagagcccggaaaaatttctgatgtatcaacacgaccctcgtactttcgagaaacttgaagtaatcatgaaacagtacgcaaacgagaagaatcccttggccaaatatcatgaggaaaccggcgagtacctgacaaagtattccaagaaaaacaatggtccaatagtcaagtcattaaaatacatcgggaacaagctcggcagtcacctggatgtgactcatcagtttaaatctagcaccaagaaacttgttaaactgtccattaagccttatagattcgacgtgtacttgacagataaaggatacaagtttatcaccatttcatatctcgacgtcctgaaaaaggataattactattacatccccgaacagaaatatgacaagctaaagctgggcaaagctatagacaagaacgcgaaattcattgccagcttttacaagaatgatctcatcaaactggacggggagatctataagattataggagtgaactctgatactaggaatatgatcgaacttgacttgccagatattcgctacaaggagtactgcgagctgaacaatatcaaaggtgaaccccggattaagaaaacgatcggcaagaaagtaaactccatagagaagttaacaaccgacgtgctcgggaatgttttcactaacacccaatatacaaagcctcagctgctttttaaaagaggaaattga

SEQ ID NO: 2645 - RNA, 3165 nt, synthetic construct
  misc_feature 1..3165: note = Cas9 variant
  source 1..3165: mol_type = other RNA
atgaagctgacacccctcaactacatccttggcctggacttggggattgccagcgtgggatgggctgtcgttgagatagatgaacaggagaatcctttaggtctgatcgacgtgggcgtaagaaccttcgatagggcagaagtgccaaaaactggggagtccctagccctcgcgcggcgcctggctcgatctgcccgtagacttgtcaagaggcgggcagaccgcattaaaaaggccaaaagactgttgaaggctgaaaacatcctcctgtcagcagatgagcacctcccgaatgacgtgtggcaactgagggttaagggattagatcagaaactggagcggcaggaatgggccgctgtgcttttgcatctgctaaagcaccgcggctatctcagtcagcgaaagaacgagagcaaatccgaaaataaagagctgggtgcccttctgtctggggtcgagacgaaccatcaaattttgcagtcggcggaatacagaacccccgcagagatcgccgtgaagaagtttcacgtagaagacggacatataaggaatcagcggggcgcttatacacacactttctcacgtctcgatctgttagccgagatggaactgctctttcagcgccaaaccgaccttggcaaccctcacacaagcgcaaaactgttggagaatctaaccgctctgctcatgtggcagaagccagccctggcgggggaggccatccttaaaatgctgggaaagtgcactttcgaacccacagagtacaaagcagctaagaacagttattccgccgaaagatttgtttggttgaccaaactcaataacctgaggattttagagcagggtgctgaacgggccctgacggataatgagcgattcgcactactcgaccagccttacgagaaggccaagtttacttatgctcaagcgcgcaccatgctggcacttccagatgaagccatcttcaaaggcgtgagataccagggggaggacaagaaagctgtcgaaacaaagactattttgatggagatgaaagcctaccatcagatcaggaaggcactggaaaacgccgacctcaaggctgagtggaatgagctgaaaaacaactctgaacttctggatgacataggaaccgcctttagcttgcacaagacagatgaggacatttgtcggtatctcgatggcaaactgtccgaatcaatcttaaatgcactgctagagaacctcaatttcgacaagtttattcaactgagtcttaaagcgttgcagcagatcctgcccctcatgctgcagggtcaacgctacgatgaggctgtgagcgccatctatggggaccattacggaaagaagtctgcagaaattaacagattactgcctaccataccagccgatgagatcaggaatccggtggtccttcgtacgttgactcaggctcggaaagttattaacgccgtggtacgactctatggctcccccgcaagaatccacatagaaacaggcagggaggtggggaagtcataccaggaccgcaaaaagctggaaaaacagcaagaggataatcggaagcagagagagagcgctgtcaagaaattcaaggaatattttcctaacttcgtgggagagccaaaaggtaaggacattctaaaaatgaggctgtacgaactccagcaggccaagtgcctgtacagtggcaaatctcttgagttgcaccgcctgttagaaaaggggtatgttgaggtggaccatgcgctccccttctcccgaacctgggatgacagctttaataacaaggtcctggtgcttgccaatgagaaccaaaataaaggaaacctgactccttacgaatggttggatggcaagaataactcggagcactggcagaacttcgtagctcgggttcagacatctggtttttcccataccaaaaagcagcgtatcctctcacacaaactggacgaaaaggggttcatcgagagaaatctaaacgatacgaggtatgtggcacgctttctgtgtaatttcattgccgacaacatgctcctgaccggcaagggaaaacggaaggtctttgctagtaatggccaaatcacagcccttttgagagggaggtggggactgcagaaagtgcgagatgacaacgatcgccatcacgcattagacgcggtcgtggttgcctgcagcactgtggtaatgcagcaaaagattacccggttcgtcagatacgaagagggtaatgtgttttccggcgagaggatagatcgtgaaacaggggagatcattccactccacttcccctctccgtgggctttcttccgcgaaaacgttgagatccggatctttagcgagaatcctaaactggaacttgagaacagactgcccgactatccacagtacaatcatgaatttgtgcagcctctattcgtctcaaggatgcccactcgaaagatgaccggacagggccacatggagacagtgaagagtgccaaacggctcgatgaaggtctgtccgtattgaaggtgccactgacccaattaaaactcagcgacctggagcgcatggttaacagagagagggaagtcactctttatgagtctctgaaggcacggttggaacagtttgggaatgaccccgctaaagccttcgcagagccttttcataagaagggcggagccgtggtgaaagctgtccgagttgaacagacgcagaagtcaggcgtgctcgtgagagatgggaacggagtagcggacaatgccagtatggtccgcgtggatgttttcacaaaaggtggcaagtactttctggtgccaatttacacctggcaagtcgcaaaagggatactaccgaacaaggctgtgactgccaacgttgacgagatcgattggctggagatggacgaaagctatcagttcatttttaccatgtaccccaatgatcttgtgaaagtaaagctcaagaaagaggagttctttggatattacggcggtctggacagggccacaggggctatcgtcattaaggaacacgatttggaaaaatccaagggcaaacagggaatctatcgtataggcgtgaagctggcattatctttcgagaagtaccaggtggacgagctcgggaaaaacatccggccttgtagaccaaccaagaggcaacacgtccgctga

SEQ ID NO: 2646 - RNA, 3165 nt, synthetic construct
  misc_feature 1..3165: note = Cas9 variant
  source 1..3165: mol_type = other RNA
atgaaggagaaatacatcctgggcctcgaccttgggattaccagcgtgggatatggtataatcaacttcgaaacaaagaaaattatcgatgccggcgtcagactgtttcccgaggccaatgttgacaacaatgaagggaggcggtccaagcgcggatctcgacgtttgaaaagaaggcggattcaccgcttagagagagtgaagctgctactcactgaatacgatctgatcaacaaggagcagatacctacgtcaaataacccatatcaaatcagggtaaaaggccttagtgagattctgagcaaggacgaattggcaatcgccctcctgcatctggcgaaacggcgcggtattcacaatatcaacgtgtcctctgaggatgaagacgcttcgaatgagctctcaaccaaggagcagataaaccgaaataacaaattactgaaggataagtacgtctgcgaagtgcagcttcagagattgaaagaggggcaaattaggggagaaaagaatcggttcaaaacaactgacatcctgaaggagattgatcagctactcaaagttcagaaggactatcataacctggatatcgactttatcaatcagtacaaagaaattgtggagacccgtcgcgagtatttcgaaggcccgggccaagggagcccctttggatggaacggtgatcttaagaagtggtacgagatgctgatgggccactgtacatacttccctcaggaattgagaagtgtcaaatatgcctactccgcagacctctttaacgccctgaatgacttaaacaatctgataatccagagggataactctgagaagctcgaatatcatgagaaataccacattatcgagaatgtgttcaagcagaaaaagaagccaacccttaaacaaatagctaaggaaattggggtaaaccccgaggacatcaaaggatatcggatcactaagagcggcacacctcagtttaccgagttcaaactgtaccacgatttgaagtccattgtttttgacaagtcaatcctagagaatgaagcaattctggatcagatagccgagatcctcacgatttatcaagacgagcagagtatcaaagaagaactgaacaaacttccagaaatcctgaatgagcaggataaggctgagattgccaagttgataggttacaacgggactcatcgactcagcctgaaatgcatccacttaattaatgaagaactgtggcagacctctcgcaaccaaatggaaatcttcaattacctaaacattaagcccaataaggtggacctctccgagcagaacaaaatccctaaggatatggtcaacgactttatactgtcaccagtggtgaaaagaacattcatccagagcattaatgtcatcaacaaggttattgaaaaatatggaatcccggaggatataattatcgagcttgcgagggaaaataacagtgacgaccggaagaaattcattaataacttgcagaagaagaatgaggcaactcgcaaaagaatcaacgaaataatcggccaaaccggcaatcagaacgccaagaggattgtggagaaaatccgtctgcatgatcagcaggaagggaagtgtctctactctctggagtccattgctcttatggacctgttgaataacccccaaaattatgaggtagatcacatcatacctcggagcgtggcctttgacaactcgattcacaataaagtcctcgtgaagcagatcgaaaactctaagaaaggaaaccgaacaccataccagtatctaaattcctcagatgcaaagttaagttacaaccagttcaaacaacatatcctgaatctaagcaagtccaaagacagaatttctaagaagaaaaaggattatctcctggaggaaagggacatcaacaaatttgaggttcagaaggagttcattaatcgcaaccttgtggatacccggtacgctacgagagagttgactagctacctgaaagcctatttttcagcgaataacatggacgtcaaggtgaagacaataaatggtagtttcaccaaccacctcaggaaagtatggcgctttgataagtaccgaaatcatggctataaacaccatgccgaggacgcactgatcattgctaacgccgatttcttatttaaggaaaataaaaagctgcagaacactaataaaatccttgagaagcccacaattgaaaacaacaccaagaaagttacggtggagaaggaggaagactacaataacgtcttcgagacccctaaattggtggaagacatcaagcaatatcgggattacaaattttcccaccgtgtcgacaagaagccaaatagacagctcataaacgatacactgtatagcactaggatgaaagacgagcacgattacatcgtgcagaccattacagacatctacgggaaggataatactaacctgaaaaagcagttcaataaaaaccccgaaaagtttctgatgtatcaaaatgacccgaagaccttcgagaaactctctattatcatgaagcagtactcagatgagaaaaaccctctggctaagtattacgaagagacaggagaatatcttaccaaatacagtaagaagaataacggccccatagttaaaaagattaaattgctgggtaataaggtggggaaccatttagacgtaactaataaatatgagaacagcacgaagaagctcgtcaaactgtccatcaagaattaccgcttcgatgtgtaccttacagaaaaaggctataagtttgttaccatcgcctacctgaacgtgttcaaaaaggacaactattactatattccaaaagataagtaccaggagttgaaggagaaaaagaaaataaaggacactgaccagtttatcgcatctttctataaaaatgatctcattaagctgaacggagacctatacaagatcattggcgtcaattcggatgaccggaacatcatagaactggattactatgacatcaaatacaaggattattgcgagattaataacatcaaaggggaacctagaattaagaaaaccatcggaaagaagacagagagcatagaaaaatttaccactgacgtgctcggtaatctgtaccttcactccacagagaaggctccccaattgattttcaaaaggggcctgtga

SEQ ID NO: 2647 - RNA, 3165 nt, synthetic construct
  misc_feature 1..3165: note = Cas9 variant
  source 1..3165: mol_type = other RNA
atggagaacaagaatctgaactacatcctcggccttgacctggggattgccagcgtgggatgggctgtcgttgaaatagatgagaaagaaaatcccttgagattaatcgacgtgggtgtaaggaccttcgagcgggcagaagtgcctaagacaggcgagtccctggccctatctcgccgactcgcgcgttcagctagaaggctgactcagcggcgcgtcgccagacttaaaaaggcaaaaaggctgttgaagagtgagaacattctcctgagcacggatgaacggctgccacaccaagtgtggcagctccgcgttgaggggttagaccataagctggaacgacaggagtgggccgctgtgcttttgcacctgatcaaacatagaggatatctatcccagaggaagaatgagtctaaatcggaaaacaaggagctcggcgcactgctttcaggtgtcgataataaccacaaactgttgcaacaggccacctaccggagcccggctgaactcgccgtgaagaagtttgaggtagaagaggggcatattcgtaatcagcagggagcgtatacacacactttcagtcgcctggacttactggcagagatggaactccttttctccagacaacagcacttcggcaacccctttgcctctgagaaactgttggaaaatctaaccgctctgctcatgtggcagaagcctgccctgagcggcgaggcaatccttaaaatgctggggaagtgcacattcgaagatgagtacaaagctgccaagaacacctattccgcggagaggtttgtttggataactaaattgaataacctccggatccaggaaaatggactggagcgagccttaaacgacaacgaacgcctggcactaatggagcaaccatacgataagaatagactcttctattcacaggtgaggagtattctgaagttgagcgacgaagctatctttaaaggtttgcggtactctggcgaggataagaaagccattgagacaaaggctgtcctgatggaaatgaaagcctaccatcagatccgcaaggtgctcgaggggaacaatctgaaggcagaatgggccgagcttaaagctaaccccaccctgttggacgagataggaacggcgttctccctctataagactgatgaagacatttcagcatacctggccggcaaattaagccaacctgtgctgaatgctctactcgagaacctgagttttgacaagttcatccagctttctttgaaagccctgtataagctcctgccattaatgcagcagggtctgagatacgatgaagcatgtagggagatttatggggaccactacggaaagaaaaccgaagagaatcatcactttcttccccaaatccctgccgatgagatccgtaacccagtcgttttgcggacactcactcaggctcgaaaggtgattaatggcgtagtgagactgtatggctccccggccaggatacacatcgaaaccgggcgcgaggtcggaaaaagctacaaggaccggagagaactagagaaaaggcaggaagagaaccgcaagcagcgagagaatgcaattaaggaatttaaagagtacttcccccattttgcgggtgaacctaaggctaaagatatcctgaagatgcggctctataaacaacagaacgccaagtgcctgtactcgggcaaaccaatagagcttcaccgtttgctggaaaaggggtatgtggaggttgaccatgcattacccttctctagaacatgggatgactcctttaataacaaggtgctcgtcctggccaatgagaaccagaacaaaggaaatcttacccctttcgaatggctggatggcaagcacaactcagagaggtggcgcgcttttaaagccttggtggaaacgagtgcattcccatacgctaagaaacagcggattctcagccaaaagctggacgagaagggttttatcgagagaaatctaaacgatactaggtatgtagcccgattcctgtgtaattttatcgcggacaacatgcatctcacaggggaaggcaaacgcaaggttttcgcctccaatggacagattaccgctctgcttcggtctagatggggcttggcaaaaagcagggaggacaacgatcgtcaccacgccctggacgctgtggtcgtggcctgctcaactgtcgcaatgcagcagaagatcacacgctttgtgcggttcgaagcgggggatgtttttaccggagagagaattgacagggaaacgggtgagataatccccttacatttcccgaccccttggcaattctttaaacaggaggtggaaattcgaatcttcagtgataatcccaagctcgagctggaaaaccggcttccagaccgccctcaggccaatcacgagtttgtacaacccctgttcgtctccagaatgccaacaaggaagatgactggccaggggcatatggaaaccgtgaaaagcgctaagcggctaaacgagggaatctctgttattaaaatgcccctcacaaagctgaaattgaaggatctggagttaatggtgaatcgagaaagagagaaggacctctacgatactctgaaagcccgccttgaagcatttaacgacgatcctgctaaggccttcgcagagccatttattaaaaagggcggtgccatcgtcaaatcagtgagggtagaacagattcagaagagtggggtgctggttcgtgagggcaatggagtcgctgacaacgcgagcatggtgcgggtggatgtcttcaccaaaggcgggaagtattttcttgttccgatctacacatggcaagtggccaagggaatactccccaacaaagcagctacccagtacaaggacgaggaagactgggaggtgatggataattccgccactttcaaattttctctgcaccctaacgacctagtaaagctggtcacgaaaaagaagacaatccttggttatttcaatggcctcaacagagccaccgggaatatagatatcaaagaacacgacctggataagtcgaaaggaaagcagggcatttttgagggtgtggggatcaaattggctctgagcttcgagaagtaccaggttgacgaattaggcaagaacattaggctctgtaaaccatccaagcgccaacccgtgcgatga

SEQ ID NO: 2648 - RNA, 3168 nt, synthetic construct
  misc_feature 1..3168: note = Cas9 variant
  source 1..3168: mol_type = other RNA
atgaacaattacatcctgggcctcgacattgggataaccagcgtgggatatggtatcgtcgattccgacacaagagagattaaggatgccggcgttaggcttttccccgaagctaacgtggacaataacgaggggcggcgctctaaacgaggagcacgtagactgaagaggcggcgcatccacagattggatagggtaaaacatttactggccgaatacaatctactcgacctgactaacattcctaagtcaacgaatccatatcagatccgggtgaaaggccttaacgagaagctgagtaaggatgaattggtcatagcgctcctgcacatcgctaaacgccgaggtattcataatgtgaacgttatgatggacgataatgacagcgggaacgagctgtccaccaaggatcaactcaaaaagaatgccaaagcattatctgacaagtacgtgtgcgagctgcagcttgaaagatttgagcaggattataaggtcaggggagagaaaaaccggttcaagacagaggactttgtgcgtgaggcccgcaaattgctggaaactcagtcgaagttctttgagatcgaccaaaccttcattatgagatacatcgatctagtagaaacaaggcgggagtattttgaaggcccgggcaaagggtcacccttcggatgggagggtaatataaagaaatggtttgagcagatgatgggccactgtacctacttccctgaagaactccgaagcgttaagtacgcttatagtgcagaactgtttaacgcccttaacgacctgaataacttggtgattactcgcgatgaggaagctaagctcaattacggggagaaattccagatcattgagaacgtctttaagcagaaaaagacaccaaatctgaaacaaatcgccaaggaaatcggagtgtccgagaccgacattaagggctatagagtgaacaaatctggtaagcccgagttcacgcagttcaaattataccatgatctgaagaatatatttgaagacagcaaatatctcaacgatgtccagcttatggacaatatcgcggaaattatcactatataccaggatcctgagtccattatcaaggagctgaacttgctaccagaactgctctcagagaaggaaaaagagaagatcagtgcactgagcgggtatgccggaacccacaggctttctctgaaatgcattaatttgctcctggacgatttatgggagtcctcactgaaccaaatggaactattcacaaagctcaatctgaaacccaagaagatcgaccttagccagcagcacaaaattcctataaagttggttgacgattttatcctgagtccagtggtaaaacgggctttcattcaatctatccaggtggtcaacgccatcattgacaagtacggcctcccggaggatataatcattgaactggcacgcgagaataactccgacgatagaaggaaatttcttaaccagctgcagaagcaaaatgctgaaactcgtaaacaggtggagaaggttttgcgggagtacggcaacgacaatgccaagcgaatcgtgcagaaaattaagctccataacatgcaggaagggaaatgtctgtatagcttaaaggatatccccctggaggacctactcaaaaatcctaaccactacgaagtcgatcatataatcccaagatcggtggcgttcgacaattctatgcacaacaaggtactggttagggccgaggaaaattccaagaaaggaaaccgcaccccctatcaataccttaattcaagtgagagctccttgtcttataacgagtttaagcagcacattctgaatctcagcaaaacaaaggatcggatcaccaaaaagaagagagaatacctgttagaggaaagggacattaacaaatatgatgtgcagaaggagttcatcaatcgcaacctggtcgacacgcgatacgcaactcgggaacttacatcattgctcaaggcttactttagtgccaacaatctggacgtgaaagtcaaaaccataaacggttccttcactaattatctacgtaaggtgtggaagtttgataaagacagaaacaagggctacaaacatcacgctgaggatgccctgattatcgcaaatgccgacttcctctttaagcataacaaaaagctgaggaatattaacaaagttcttgatgctcctagcaaggagatcgacaagaaacgcgtgacagtacagtctgaagatgagtataatcaaatgttcgaagacacccagaaggcgcaggcaatcaaaaagttcgagatacggaaattttcacacagagtcgataagaagccaaacaggcagttgattaaagacacgctgtacagtacccgaaatatcgatgggattgagtatgtggttgaaagcatcaaggacatatactccgtgaacaatgataaagtcaagacaaaattcaagaaggacccccatcgcttactcatgtatcggaacgacccgcaaacttttgagaaattcgaaaaggtgtttaaacagtacgagtctgaaaagaatcctttcgccaaatactatgaggagaccggagaaaagattagaaagttttcgaaaacaggccagggtccctacatcaacaagatcaaatatctgagggagcgtcttgggcgccactgcgatgtaactaacaagtacattaatagccggaacaaaatcgtgcaactgaagatttattcctacagattcgacatatatcagtacggcaataactacaagatgatcaccatttcatatatcgatttggaacagaaaagtaattactattacatttctagggagaagtatgaacagaaaaagaaagacaagcaaatcgatgacagctacaaatttataggatccttctataagaacgatatcattaattacaacggcgagatgtaccgagttatcggggtcaatgactcagagaagaacaaaattcagctcgatatgatcgacataagcattaaggattatatggaactgaataacatcaaaaagacaggagtgatctacaaaaccattggtaagtctactacgcacatagagaagtatacaaccgacatcctaggcaatctgtacaaagctgccccacctaagaaaccccagctcatttttaagcgggggatggaatga

SEQ ID NO: 2649 - RNA, 3168 nt, synthetic construct
  misc_feature 1..3168: note = Cas9 variant
  source 1..3168: mol_type = other RNA
atgacccccatcagcgagtccctactcttcggccttgacgtggggatttcttcatgcggatgggccgtcctgaagcacagtgatacaactggtcatatagaggctttgggcagctggtgttttaacgcacctgaaacgaaaaccgaaagaacaccaactaatcagatcaggcggtcctctcgcttactgcgacgtgttgtgagaaggcggcgcaacagaatgaccgagattaggcggctattcgcccgccacgggctcatcgacaatgatcgaccggacgcgctgagacaacccgctattgatccttgggaaatgaggggacagggccttgaccggcagctgacaccagaggagtttgccgtagcattggcccatatcgctaagcaccgtggtttcaaatcgtcagcaaagcgcgtgaaaagcaacgccagtcccgatgactccaagatgctcgctgccctggaaaagaccaaagagctgtctgcgcagtacagaactataggggaaatgtttgcaagggatagcgcctatgtccaacggcgacgcaatagagacggactcttcgataggacaatctcccgggacgatttaattgacgaggctaagatcctgtttgaccgccagagaaaacttggcaaccctgtggcctcaaccgagattgaagaggcattcacgaggatcgctttttggcagaatccaatgcaggatagtggcgttttggtggccagctgccccttcgaacctaaggagaaacgttcttcccggttttcaccgagcttcgaacgatttagactgctatgtaggctcataaacctgcgcgtcactgacgggccagaggagcggccccttaccgaagaggaactgagattggcgtacgagcatgccggaaagacaaggaagctcactgcagctgccattcgcaaactgatcggtttacgagatgaccaacacttcaccacaattcctccagaacaggagaagcaggatatcaccagtcggacgggcgagactttcgctgggacagccacctttcgttctgtgctgggagaatccctctggagacagcttctgccccaccctgagtggttggacaatgcagcctggatcattagcttccatgaactaactgagacaataatcaaaaagctgggcgaaattggtctcccagtagaggcttatgagctgatctgcgatgcgcttaaatcggacaagtctccctttgcaaaattcaagggggcctcctcactgagtgataaggctgttagggccttgataccgtacctccaacagggactgacctatgacaaagcatgtcagaaggccggctacgatcacgctgccagccgcttttccggccgggcaacgattgacaccaaagcgaagttcaacgctttaatggccgaagtgagagactctatcgcaaatcctatcgccaggaaagctctgagcgaggggatgaagcaactatgggccatgcgaaaccgctggggactccccggtgcaatttgcatcgaactggctcgggatgtcggcaattcacttgagaagagaaaagagattgaaaggaacttgaagacaactgccaaacagcgtgcgcgcgagcgggaagaggcctgtgaactgctcaatctgaaggaggtgagttccgacatacttctgagatataggttgtggaaagagcaagggggacgatgctgttacagcggcaagtctatcaccccagatatgctcatggctcaggacaaccggattcagatcgatcatatcctgccttggtcacgctttggtgacgatagttacagcaacaaggggttatgcctggcaaaagaaaatcaggccaagaaaaaccagacaccctatgagtggattcacggccagggaactaccgctcaaaaggaacagtgggacaaattcgtggccgatgtcgagtccagaaagaatacaaagggcctgaaaaagaggaactttctcctgaaagggtctaaggaaatagaggagcggttccgatcgagaaatcttaacgacacccgctacgcagcgaggttgatggttgaagccgctcgtctgctctatccagccggacagcggggtgagaaaggcgggactagaagggtgtttacgcgccccggagcactgacagctgccttacgacacgcatggggcgtagaaagcctgaagaaaatcgatggtgagagacttcatgacaatcggcaccatgccttggatgctgcgattgtggccgcagtctccgaagctgagatccagaagctcaccaagtcattccaagagtgtgaacagaaagggctgagtaggcctatgcgcgacgtggccccaccgtgggacggctttcgtgatcagctaaaggagaaatacgaaactattttcgttgccagacccgagcggcagagggctcgcggacaaggccacgaggcaaccatccgacaggtgagagaagaggaaacagggcctgtcatatatgagcggaaggccgtgtctgcgctgaccctcgctgacctggccaaaatcaaggatccagacaggaacgcaggacttattgccagcttgcgccagtggatcgaagctggtaagcccgcagataaacctccaagaactccctgccatcaatccgccgcgggccacgagattaggaaggtacggctggctacaatcataacgccggccgttcctgtgcgtgggggaatggcaaaacgcggcgagatgacccgagtcgacattttcaaggtgatcggtaaaaaggggaagccagaatggtacatgattcccatctatcctcaccagataatgaatagatcacagtggcccgccccacctaacaaagctgtcgtggccggcaagagcgaggcagattggcccatcatgggagctgaagcccagtttcaattctctttatacccatgctcctacgttaggctctttaaagagggcactgtgattgaagggtatttctgtggatgccatcggagtcgcgcgtacatcacactggcccttagcaccggcgcagctccgctgcagaagggtattgggatcaaaacacaggagcacatacagaagttttctgtaaatagattcggagagttgtcccctgtcaagcaagaaactaggacctggcatggcgtggcctgtacgtcacccgaccagcacgattga

SEQ ID NO: 2650 - RNA, 3171 nt, synthetic construct
  misc_feature 1..3171: note = Cas9 variant
  source 1..3171: mol_type = other RNA
atgaaggccctgaactacatcctcggccttgacctggggattgctagcgtgggatgggcagtcgttgagatagatcagaatgaattgcccatcagattaattgacctgggtgtgaggaccttcgagcgggccgaagtacctaaaacaggcgattccctagcgctcgctcgccgactggcccgttcttcaagaaggcttgtgcggcgcagagcagtcaggctgttgaaggccaaacggctcctgaagcaagaggggatcctgcaggctgacgattttcacagtagccatctcaaaccattaccgaacaatccctgggaactgcgcgtgaagggacttaaccacttgctggaccgaaaggagtgggcagccgttctactccatctgcttaaacacagaggctatctgtcccagaggaagaatgagtctaaaactgataacaaggaattgggtgctctcctgaaaggggtgtcggagaatcggcagttactgcaagcccaggcgttctcaacgcctgcagaaattgccatcaagaagtttcagcaggaggagggacatatacgtaaccaacgcggcgcttacagccacaccttcgacagaaatgatctccttgccgaactgaggttgctatttcagaaacagcgggagttcaacaatccatatacaagtcagtccctggaacaagcaatcgctgagctcctgatgtggcagaagcccgccctttctggcgaagcgattctgaaaatgttggggaagtgcacttttgagcctagcgagtacaaagccccaaagaactcctattcagcagaatacttcgtctggctcaccaaactgaataacttacgaatcctggagaatggagctgaccgcggtctaacagccgaagagagacagctcctgattaaccaaccctttgaaaaggctaagttcacctatgcccaggcaaggaaacttttggagctgagtgatctcgccatctttaagggcgtgcggtacgggaaagacaacgctgagagcgcgactctgatggaaatgaaggcatggcacgccatacgcaaagctcttgagtctaatggactgaagacagaatggaacggcttgaagaccaaacctgagctcctggataagattggtacggccttctccatctacaaaactgacgaagacatttcacagtatttaaatggggagctgagcccagcagtactaaacgccctcctggagaatcttagttttgataagttcatcagattgtctctgcagtccctcgctaaaatcctgccgttaatggaacaaggactgaggtacgacgaggcctgtaagcaggtttatggcgatcattacggcaagaaagaacagcttgagttgcgtttcctccccaagattcctgtggaggacatacggaacccagtcgtgctgcgaaccctaagccaggcaagaaaagtgatcaatggggtcgttaggctgtatggatcgcccgcgcgcattcacatcgaaacaggtcgggaggtgggcaagtctttttccgaaagaagggatatatcaaaacgccaagaggaaaaccgaaatgagcggcagcgtgctgtagagaagttcaaggaatttttccctcattttgtgggggagccaaaagccaaggacattctcaaaatgagactgtacgaacagcagcacggaaagtgcctttatagtggcaaagagttggatctgaacaggttactcgaaaagggttacgtcgagatcgaccacgcactgcccttcagccgcacttgggatgactcctttaataacaaagtgcttgttctggcctctgagaatcaaaacaaggggaatcagaccccgtacgaatggttgaacggcaaggagaacgctgaacggtggaaactcttccaggccctggtgaatggaagcagatttccttattcaaagaaacagaggatcctaacaaagtacctggatgaggacggcttccgagaacgcaacctcaatgacacccggtatgtcgcaagatttctgtgtaacttcattgaggataatatgcaacttgtggggcagggtaaaaagagggtatttgctagtaacggacagatcacggccttgctgcgtcgctcctggggcattcaaaaggttcgggaggacaatgatagacatcacgcggtggacgccgtcgtggtcgcttgcagcactagggcattacagaaaaagataacagattacgtgcgatataaagaaatgaacgttttcaccggggagaagatcgaccaggaaactggagagattatcaaattccattttcccgagccatggaagttctttcggcaggaagtggagatccgcgtattctctgaaacccctgccgaggatgtcgtgattgctctccccgacagaccacaagccaatcacgaatttatacagcccctgttcgtttcaagggcacctacacggaagatgacgggccagggtcatatggagaccatcaaaagtgcgaagcgacttgccgaggggctgagcgtgtccagagtcccactaacacagctcaaactgaaggatttggaaaacatggtgaatcgcgagagggaaaaagctctgtacgaggccttaaaggtacgtctcgaaaagtttaacaatgacccggcaaaagccttcgctgatcccttttataagaaaggcggacaacaggtgaaggcagttcgggtcgaacaggtgcagaaatctggcgtgctggtcagacaagagaacggggttgccgacaatgcttcgatggtgagggtggatgtattcattaagggaggtaaatactttcttgtccctatctacacttggcaagtggcgaagggcattctgccaaaccgcgccgcaacccaggggaaggaggaggaatattgggacatcatggacgagacagctatattccagtttagcttgtaccagaacgatctcatcaaactggttactaagaaaaagaccattttcggatatttcaatggcctaaaccgagccacatccaatatcaacattaaagaacacgacctggataagtcaaagggtaaagacgggatctaccttgaggtgggcgtcaagctcgccctgagtttggagaaatatcaggtggatgaactgggaaagaatatacagccctgtagatctatgaaaaagcggcctccagttaggtga

SEQ ID NO: 2651 - RNA, 3171 nt, synthetic construct
  misc_feature 1..3171: note = Cas9 variant
  source 1..3171: mol_type = other RNA
atgcccaagcagaaaagcaccagatacaggctggccctcgaccttggctccacatctctggggtgggctgtgttgcggttaaacgagcaacacgaacctaatgcaatcattcgcgccggagtccgaatattctcaaacggtcgtaatccaaaggatggcagtagcctggcggttactagaagggctgcccgggcaatgcgcagaaggcgggaccgcctactcaaacgaaaggccagaatgatgaacaaactggtggagtatgggtttttcccggctgatgtagcagaaaggaagaaacttgagcggatcaatccctacgaactgcgtgccaaaggattggacgctcctctcacgccaggcgagtttgcccgcgcgctgttccatattaaccagagaaggggttttaagtccaatcggaaaaccgataagaaagagaacgactctggggcactgaaggccgctatctcgcacctccgacagcagttacatgaacgcaaggccagaacagtgggagagtggctgtggcaaaggcttcaggcaggcttgggcactcgggctcgctatagagaatcaagggtcgcccaggcgaatgggaaaacccgtattgaaaagagctacgatctgtatgtggaccggcagatgatcgccgaggagttcgatgcactatgggctgcccaagctgcctttaacccccagcagttcagtgagcaggcacgaggagaactcagagacgttctgctttttcaaagggatctgcgccctgtgcggccaggtagatgcacattgctccccgacgaggaaagggcccctctggctttaccatccgtccagcgcttccgaatactgcaggaggcgaatcacctccggcttctgcatccggatttgcgtgaggaacccctatctctggcacaaagagacgccgtggtagacgctctcgagcacaacagcaaaaggacctttgaacagctgcgcaaacttctgaagttgaatggcactgttaagttcaacctcgaggatgaaaaacggaaggagctgaaggggaatgccacatccgcaaccttatcaaaagacggactgtttggcgagaactggtggaacctagatgaagccctccaggacgctatcgtgtggcagctggtcagtgagcaaagcgaagagaaacttcagaattggttgcaggccaacacgggtgtgaatgcaactcaggcggaaaccattgctaacgccgggctgcctgagggatacggctctctctcctataaggcactggccagaatcattccagctcttaggggcacagaggtggccaatgggatcgatgtcccccgaacttacgaccaagcagttcaggctgccggattcgcgcaccattcagatctggacagcggtttcgattttgaacacagtcatgacgaggtggaacgcataggcgagcgggtaattgcctctaccggggaggtgaagcctgtcttcgcttttaaacagttgccatactatggaaaggcactcagaaggcacgtggccttcgctaaggaacacccccgtaacgaggaggaacgctacggcaaaatcgccaatccgacagttcatattggtctgaaccagttacgggtggtcgtgaatgcactgatcagaaggtatgggcgacctaccgaagtagttgtggagctagcgcgggatctcaagcaatcccgcgagcagagacaggaggaacagaaaaggcaagccgactaccagaagcggaacgaacacatccgaagagagattgctagcatgcatggctgtgccgaggaacgcgtctcgcacgcagacgtgcagaaatggatactgtgggaggaactttcttttgatgtcgctgacaggcgttgcccctattccggagtgcaaatctcagcccagatgttgctgagtaatcaggttgagattgaacatatcctcccattcagccagacgctggataactccttaaataaccggactgtggcaatgagacaagccaataggataaagggcaaccgcacaccttggcaggctcgagaggactttgaaagacaggggtggtcttacgatagcattctgcagcgggcggagaggatgcccaaggccaaacgctatcgtttctcaagagacggatacgagcggtggcttaaggaagataaagactttttggcaagggctctcaacgatacccgctacctgagtcgagtagccaagacttatatggagctagtctgtccactgggtacaagagtgatccccggccaaatgaccgccctcctgcgggctaaattcgggcttaatgacgttttgggactgaacggcgaaaagaatagggatgaccaccgccaccatgcagtggatgcctgcgtcatcggtgtgacggaccaggggttactccagagatttgcgcaggcttccgccgacgcaaggggcaacggactggagaaacttgtagagaatatgcctgtgccatgggccacctaccgggatcacgttaagcgtgctattcaatgtatctgggtcagccataagccggaccacggctatgaagggcccatgatggaggaaacagcatacgggattcgcaaagatggttctatacgacagaagactaaagccgacggctcaaccgggagagagatcacacacctgattaggatcactgaacctacccagaacttgcggcatggagtggatgcgcaaggccagccactcgcttataagggttacgtgggaggcagtaatgactgcatcgagattacacagaacgagcagggaaaatgggaaggcaatgtcataaccactttccaagcctatgatatcgttcgcagactggggagcaagcagggacccaggcggctacgacaccctacgctggcacagacactcgacgtgtacggcaagccaaagaagctggtgatgagacttatgattgatgactgtgtacgcttggagctggatggtaacaaaaagaccttaagggtcgtgaaaatcactgggaatggacaggtttttatggcccccgtgcatgaagctaacgtcgacaagcgtaattccgataagaccgacccgttcgcctacgtgtctaaatatgcaggctcgttccaaaaggctaaagcccggagaattacaatcagccctataggtgagctccacgacccaggcttttga

SEQ ID NO: 2652 - RNA, 3174 nt, synthetic construct
  misc_feature 1..3174: note = Cas9 variant
  source 1..3174: mol_type = other RNA
atgagcgacaagtccaaaatcctgggcttcgatattgggataacctctatcggatgggcctacgtggagggtgaagaactcattgactgcggcgtcagaatctttacaaaggctgaaaaccccaaaactaaggagtcacttgcactgcctaggcgggaagcccgcggggttcgacgtagattggcgaggcggaaaggacgcttaaatgctattaagcagctgatctgtaaggagttcggcctaaactatcaagattacatagcccaggacggtgagctcccaaaagcatatgccgggaagctgatcaatccgtacgaacttagaagtaaagctctgagggagaagttggaaaaagaggagctcgcacgggtgattctgcacatcgccaagcatcgcggatatggcaacaagcacgctaaagaaacggatgacgccgagagcggcaagattaaaaaggcgatctccaataacgaaaagatactgaatgagaaggggtaccagtctgcaggagaatatctctaccaggagtttttccaaaaagagcgattacaggaagagaagaagggtaacaataccacaaaagaatttaagaacgtaagaaataaagccggcgattacgagcattgcattgctcagactcagatgcaaaacgaactgaggcttatcttcgagaagcagcgggagtttgggttgaatttctcggaagagtttaaaaagaaggtgctggaaaccgccttctttcagcgtcccctaaaagacttctcagataagattggagactgtacatttatcgagggcgcaaaacgcgctcctaaggatagcctcagtgccatcgagttcgtcgcgctgggtagaattataaacacccttaaaaatctgcagaacacttccggggaggtgtattctagggacaagatcaacgagattttgcaaatcgttctcgataagggagaaataagctacaaaaagctgcgggagattttagacatcgaatcctcagtgcgattcaaagacagtaagctggattatacaaaagagctcaaggaggccgaaaagaccaaactttttgagagcaagaatctgcagaaattcaagaaagcattgggctcttttgaaggcatctcccgcgagattctagactcaatcgctaaggaaattatgataacgaaagataaggagaagctggccaaagagctcaagaaattcccactggacgaaactcagatccaaaaccttagcaatctgagtttttctcagaccattaacttgtccctcgaggctctgagccagatcttacccttcatgagaggggaaagggaggataagtgcctgcggtacgacgaagccgtcgagaaagcaggactaaaggaggtggccaagaataaatcgaaggatgactttctccctccactggaaaactatgagccctaccttgctaatcctgtagttgcgcgcgcattgtctgaatatagaaaagtgctgaacgccctcctgaggaagtacggtaaaatgcacaagatccatattgagttcacacgtgaagtcggcaagtccaaagaggagcggaataagatagaaaaagagcagaaggaaaactttgctaaaaatcaagaggcccagaagcagtgtgagatccttgggctgccaattaacggagcaaatatcttgaagatgaaactctggcgagaacagcaagagtcatgcgtgtacagtggcaaggaaattgccatcgatgacctgaaaaacccggctatattacaggtggatcacatctatccctacagcagatccttcgacgactcttataataacaaggtcctggtttttagcaaagagaaccagaataagctaaacaaaactcctttcgaagcctttggtgagaataaggataagtgggagaaaattctctcactggcaagtaaacttccaaaacccaagaggcagcgcatctacaacatgcaattcaaagacaaggaacaggggttcttgacccggaatattaacgatacaggctatatcgcgagactggtgtcccagtggaccaagaattgtctcagctttgagaaactgtctgaagacgaggtatcaatagctggagaaaagggcagtaaagtgcacgtcgaggtgattagcgggtccttaacggccatgctgaggcattactggggacttggtgataagaaccgcgacaatcacttgcatcacgcagttgatgccatcattatcgcttattctaacgagaaagtgataaaggccttctcggactacaagaaacaccgagaacagaataaggcaaaattttacgctaaggagatcgccgaaagcgagtataaaaagcaaaaggtcttctttgaacctactaaccatttccggcagaaagtgctcgagaagattgattccatctttgtatcaaaaccaccccgtaagagagcgaggggcgccctgcacgaggaaacattctacagttttgagcgcctatgcaatgacaaagaatatgctaagaaggagaaaatggattacgggggaaaggcaggcattcagaaagccatcgctctgggtaagatacggcaagttgggaccaaaattgtgtctaacggcactatggtcagagtggacatcttccagcataagagcaatggaaaattttatggcgtcccgatctacacaatggatttcgccctcggggtgctgcctaacaaggcagttgtgtccggaaaggacaaacagggtgtaattaaggactggcttgagatggattcaaactatgaattttgtttcagcttgttcaaagacgatctgatcttagtccagaagaaagagatggaaaaggcggagctctgctactacaccgactttaattctaacacggccggcattaagttcgaaaaacacaataacctgtatgtgaatcttaacgagaatgagaggaagctgtttacctccaaagaagttgtgaaagggggaaagaagaacgtctggaaggataaaacacccaaggagatagaacaattggagaaaaatcgaaagatcattggcggtttcgtgactatcgaagacctcaaaacctttgagaagtaccaggtaagtccactgggggaggtgcagaaggctgatttcgcccctcgccaggcaattacactaaaaagctctcccaagcatcggatcaacaaatga

SEQ ID NO: 2653 - RNA, 3174 nt, synthetic construct
  misc_feature 1..3174: note = Cas9 variant
  source 1..3174: mol_type = other RNA
atgagcaacagagtgccctacaggctggccctcgaccttggcaccaattccatcgggtggtgcctgttggatttaaacggaaatggtgacccttgtggcgtccggcgcatgggggttcgaattttcccagatggacgtgacccgaagtctaaagagtcactggctgcagatagaaggctagcccggagtatgcgcagaaggcgggaccgctatctccgaagaaggagcgcgctgatgaacgctcttgtggccgcaggcctgatgcccgccgatcgggctacacgtaaggcattggaatccgaggacccttgcgaactccgcgccagagctctgtttgagccactgactgccggtcaggtagggagggcgcttttccacttaaatcaacggcgaggatttaaatctaaccgcaaggcagccggcgaagagaatgaggctggcaaaataaaggccgggatctcggcactgaaggctgaaattgaggcctcaggagaaacgacccttggtgcgtggttggccgcaagacataggaaacgggagacagtgcgcgctagactggatggcgccggggctaaggccagctacgagttctatcccgaaagggggctagtccacgacgagtttcaggcaatccgtactgcccaggctctccatcaccctgcggtgaccgcagaacagtgggatcgggttgagagtgtgattttccgacaaagaccactgaggcccgtccgccctggcaaatgtacactttttccagaccaggaacgggccccgtgggctctgcccgtggcccaggagttcagaatcttgaccgagataggtaacctcaagctgtacaggcctggggaagaaccacgcgaattatccgcagatcagcatgcccaactgtttgctaaactctgccgatctgccgaccttactttcgagaagatccggaaggaactgaaattggaccccggactaaaggtaaatctggagggcgagaaacgtgatagactcaagggcgacgcagttacaagcgcgctgtccgctaaaaagaggtttgggcctaaatggaacgcccttaccccagatgaccgccgggatattgtgggaagactgatcgaagcagaggacgaagccgagttggctggttggctcgaatcagtccacggcctgcccagtgagaatgccgcacacacggctgccagcccggggttacctgatggatattgtaggctgtctgagaaggcgctagtgaagctcgtgcccctgatgcgagaacagcgccttcggtacgacgaggccgtcttggctctgaacctccatcactccgatttcagaccagaaggcctgcttgacgagctgccttattacggtgagcccttggaaaggtttattgcattcgggtcaggcgagccaagcgatccccctgaacagcatctcggacgtttcccaaatccgactgttcacatcggcctgaacgagttacgcaaactggtgaatcggatagtagaaagatgggggaagcccgccgacattgtggtcgagctagctagggacctcaaacgaagtcgggatgagcgcgacaccatccagagagaacaagcccagaaccagaggaagaacgaggatcggtttgcaaaaattaaggaactgggaatcgaccctcgaccagattctatgcttagattgcgcctgtgggaggaactccccaaggtgggtgttggccacgtgtgcgtctacacaggggagcctatcggaattaggcgtctgttagagggcgacgtggatatagaccatatcctgccattctcccggactcttagcgatggtgcggacaataaaattgtatgtgttagaagggccaaccgctttaagcgagatagatcgccctgggaggctttcggggtgaccgccgtcgacggctatgattgggcagctatcgcccaacgggcagaggaattgccgaaaaataagaggtggcgctttctccctgacgccatggaccgtttcgagggagaaagaggctttctggatcggcagctagtggagacaaggcacctgtctcgcgtcgctcgacagtacctcgcgtccatagtggacctgaacaaagttagagtggccccagggaagctcaccgcaatgttgcgggctaggtggggactgaataagattttatcagatggtaacctcaaaaatcgcagtgaccatagacaccatgccatcgatgccgctgtactgggcatgatcgaccagaggcttgtccaactggtggcacaggccgcggctcgggccgaggcaaacgaattggagcgtctcttcgatgggctgcccgacccttttgatggactagccgctacgagcttcggcgaccaggttcgcgaaaagattcgaggtatcactgtgtcccacagagcagagcacgggtggcagggcaggatgcataatgatacagcctatggacccgtcgaggcggtgaacggcgtacacaccgtggttactcggaaaccactgtctgggctcacagctaaggactttcctaatattcgcgatagagtcctggccaaagcacttgaagaccatgtggccgctgaggccgcagctggaaggagcttcggcgacgccttgggttcatttaagtggggaggacaacccgtgcggcgagtcagaatgctggatgttttaggcaacccaataccgatccaggaccctagtggtaccgtgttcaaggtgtacaaaggcgattccaatgcgtggtatgaaattctccgcgaccccagggggcggtggacgggaaagatcgtaagcaccttcgaggcctaccgtctgcacagagaatggcttgcagagacaggcggggattctggaaggggctcaggtgtctttctggactgggctgccaaacgcgtggttggggaggctggaactccactattccggctctttaagggcgatctgttggcactgggtgaagcccccgaccgaagaatcgtgagggtcgtgaaattcagtgagggccaggttgccttagctctccacctggaagcggggaaccttaaggcacgcgatgccgacaaaggagatccttttaagtatcagtactgcagcccagactccctgcggaagcaagctgccagacccgcaggcgtggacttgctcgggtacgtacatgataaaggacctctggagtga

SEQ ID NO: 2654 - RNA, 3174 nt, synthetic construct
  misc_feature 1..3174: note = Cas9 variant
  source 1..3174: mol_type = other RNA
atgagaaggctgggcctcgacattgggaccaacagcattggatggtgccttatagaggatgacaagaaaatcgtggatattggtgtccggatcttctccgacggccgcgatcccaagtctggggcctcactggctgttgaccgacgtgatgcaagagccatgaggcggcgcagagacaggtacttgggacggcgcagtgcgtttttacaggctctggtggtacacggcctaatgcctgccgatgcagacgaagccaaactcgtggctgatcgagacccatatcaactgagagcaaaggcccttcatgtcgctctggagccgttcgaaattggtagggccttgtttcacctcaatcagcggcgtgggttcaaaagcaaccgcaaggcggatagaaaggcaaatgccggagaggacggcaaaatcgctgaaggcgccaaggcactggaccaggctatgtccgaggccggggtggatacactgggacagtttctcgcgttaaaagagactaagagggttcggctgggttctgacggccaagcctacgatttctatccccagcgacgccatatagaatacgagtttgacagaatctggaaagtgcagtcggaatatcaccctgcacttttgacggaggctgccagggctgccctgcatcggattctattctttcagcgcccactcaaggcacaagaggtcgggttctgtacctttgccggagtgaacggcatcgctgcgaatgaaagaaggctgcccaaggcacaccctcttttccagcagcgtcggctgtacgaggaagtaaaccagttgcgaattgtttcagccggtgctgccgatagaccactcacactggacgagagggatcgcttaatcctgcggctccaagacagaaagaaggtgagctttgatactcttgccaaaaaggacctgaggttggcagatggggaacgcttcaataaagagagtgagaaccgaaaggaactaataggagacgaggtccgggctgaaatgtccgacaaaaagcgtttcggcaccagatgggtgcactttggcctggatgagcagctcaggattctggccaaacttcaggacgaagagaatcccgaggcactgttggattggctccgctctgaatatgggctggacgaggcggctgccgaaagcgtggcaaacgcccggttacctgagggatacggtagattcggcgaaacagctaccaggctgctactcgatgccctgaaagcagaggtcatcacttacgacaaggctgcccttcgagcgtttgggcatcactccgatttccgcacaggagaggttttggaccggctgccatattacggcgaactcctgaccagagagattgccccgggtaaacccgaatatggggatcctcttgagaggcaatacggcaagatcacgaatccaactgtgcatatcggactgcgtcagttggagaaactcgtaaacgctgtgattgcagtccacggccgccccgaccagatagtggttgaactggcccgggagttaaagctgaatgaaaaggagaaagatgaacacaagagaaggatcaaacgagacaccgatgctgccattgcacgggggcgcaagctagcgtcagagggatttatcgacaacggtgccaatagaatgctcatgaggatatgggaggaactgaaccctgctaacccacttgaccggcgatgcccctattgtgccgagccgattggcatcagagcattgttcagtggggaagctgatatcgaccatattatcccttacagccgctctctggatgacaatgtgggaaacaaagtcgtggcccacaggtcctgcaatcgtgcaaagggcaacaagacaccctatgagaaatggggtccacatattgatcctgaacggtgggagagaatatcagaccaggtagccaggctccacaagagcaaacaatggcgctttgggcccgatgctatggagcgaatcgacagagatggcggattcctggcgcggcagttaactgacacccagtacctgagtagggttgccggcaagtaccttcgctctttgtatccaacagcacagtccgggcgtgtggatgtcattcccggaagaatgaccgctatgctccggaggaaatggggtctgaatagcctactgcctgaccataactacgtggaaaatgagcactcgaacgccccaaagaatcgcctcgatcaccgacatcacgccatcgacgctgcagtcgccgcggtgacgactctgtctcttatgcaacagatcgctgacgccgcaggcagagccgaagataagaacttggaccggctgtttgaggatattccgcagccctggcctgggttcagggaagagttaggagaggctctccgctccacaaccgtttcacataaagcagaccacggcagaaagaggcggccaagtcgtgatcgcgacgtgactgccgcgcgactgcacaatgatacagcttatggtcttaccggggacgtagccgcagatggcaaaacgcccatagtcgtgcatagagttcctctggccagcttgaagccagctgacctcatcgatcccctgaggattccggaccctgtgctacgggacgccctgtacgcagctacccgcgatagaacaggaaaagaatttgagcaggccctcactcaattcgcgaggcaccatccactgtttaagggcatccggcgagtcagagtgcgcgaaccccttaacgtaattcctatcagggacgccgcagggcgggcttataaagcctacaagggagatgctaatgcacgtttcgacgtgtggagattgcccaacggcaagtgggtttccgatatagtctctatgttcgacgcccactgtatggccgataaaagcgacaggcgcccacatcctgctgcgaagaaagtgctgtcattacggcagaatgatatggtggcaatcgagcgaagtggtgtcacccagattgccagagttgtgaagttttccacaaacgggagcatcgctctcgccgcagacaacgaggccggagctctgaaagcgagggatgccgcacccaatgacgtggatccattcaagtatatcttttcttcaggcggtggccttaagaacctgaaagctcgccaggtacgggtcgacccgctagggagagtgttcgaccctggaccccgtgaatga

SEQ ID NO: 2655 - RNA, 3177 nt, synthetic construct
  misc_feature 1..3177: note = Cas9 variant
  source 1..3177: mol_type = other RNA
atgaagaacagctacatcctgggcctcgacgtggggattgcctccgtcggatatggtcttatacactctgattcaaaaagtgttatcgacgctggcgtgagactgttccccgaggcaaatgtagaaaacaatgaggggaggcgggccaagcgcggaagccgacgtttgaaaagaaggcggattcatcgcttagatagagtgaagtacctgctagcgcagtatcacctcatcattgacgataaaatccctaagtccaccaacccatacgctataagggtcaagggcctgtcttcggccctttcaaaaagcgaactggtgatcgcattgctccatctggccaagcggcgcggtattcacaatgttaacgtggtcatggacgagaatgaaagtacaaacgagctgtccactaaagagcaactcaaggaaaatgctaaacagttagagaaccgatatgtgtgcgaactgcagcttgatagattgaatgagcagtacaaggtaaggggagagcggaaccgttttaagacggaagacttcgttcgcgaggcaagacaaatcctgaccacacagcagaaatatcatgatattgacgaacactttatcgagcagtacactcacctactcgaaaccaggcgggagtactatgagggaccgggcaagggctctcaatacgggtgggaaggagatctgaaacagtggtatgagatgcttatgggtcgatgtacatacttccccgaagaactgcgcagcgtgaagtatgcctacaccgctgacttgtttaatgccctcaacgatctgaataacttagtcatagcgagagacgaaaacgagaaactggagtatttcgaaaagtaccatattatcgagaatgtgtttaaacagaagaagtcccctactctcaaacagattgcaaaggaaatcgacgtgaaagagtcagatatcaagggctacaggattacaaagaacgggaagccacaattcaccagttttaaactttatcacgacctgaataaaatattcttggataagaaaaacctagaaaatatcgagctgctcgacgagattgcctttatcctgacgctttaccaggatcccctgagcataaaggaagcattggaccagctccaagatctgttaactgagtctgaaaaagaggccattgcacatctgaacggatataccggcacacaccggctatccctcaagtgcctgcaccttttgatcgacgagatgtggcagacttcacgcaatcagatggaagtcttcaccgctctgaacctcaagcctcagaaataccaactgagcaagcagaaacagatcccaaagaaaatggttgaggaatttattcttagtcccgtggtaaagagatctttcatccagtccattgagatagtgaatacaatcattaagaaatatggtctgcctgaagagatcatcattgagttggccagggaaaagaacagcgaggatcgtcggaaattcctcaatcgaatacaaaaggaaaacgagaataccagaaaacaggtcgaagaggtgatcagggagtacgggaaccgcaatgcgaagggactggttgagaaaattaagttacatcagatgcaggagggcaagtgtctgtattcgctacaaaacatcccactcgacgatctgcttcggaacccgtctcactacgaaattgaccatatcatacccagatccgtgtcatttgacaatagtttcaacaataaagtcttggtgaagcaggaggaaaacagcaaaaagggcaataggacgccttaccagtatctgaactccaatgagtctgtactcagctacgttcagtttaaacaacacatcctgaacttatcaaagagtaaggagcgcatttccaaaaagaaacgagaatatctgcttgaggaacgggatatcaataagttcgaggtgcagaaagagtttattaaccgtaatttggtcgacactagatacgccacaagggaactcgtgcagctgctaaagagctatttctctgcaaacgatctggacgtcaaggtgaaaaccatcaatgggtcatttactaactacctccgcaaggcttggaaattcgataagagtcggaataaaggatttaagcatcacgccgaggacgctctgataattgccaacgttagctatcttttcaagcaatccaaagaattgaaggaggcaaacgccatcctggaaaataacaatttatctctcaacaaaaataaggattcgaaaaacctgcttacagagcaggactacagaaagatgtttgagattccaaaacaggtgcaggatatcaaggactacaaggatttcaaatatagccacagggtagacaagaaacccaatcgacaactgataaacgattccttgtactcaacccgcgaagtcaatgagaaccattatatcgtgcagacggttaaggacatttacgctaaagacaataccaagatcaaggatctctttctgaaaacacctgaaaagctactgatgtatcagcacgacccacagactttcgagaaactcatgctggtgattaagcaatacggtgaagagaaaaaccccttcgcgaagtattacgaggaaaatggcgagtaccttaccaagtatgctaaaaacgaaaaggggccgacaatcaaacggttgaagtacatagggaaaaaggtcggcactcatctggatattagtaccaatttttctggtgccaagagaaaagtggtacagttaagcatcaagcctttcaggtttgacgtgttccactccaaagctgggtatcacatgctcacactgacctacatggatatcaagaaaaaggagaagcattatcagattcttaaaaacgaataccaggccctgaaggagcgttataaagttccctcagacgcacaatttatcggcagcttctactacaacgatctaatttctataaatgacgagctctttcgcgtcatcggagtgaacaattccactcggaacgtggtcgaactgaatatggttgatattaactataaggactactgcgatttgatgggcatcaaaaagacgccaagaattttcaaaacaatcaccaagaagactgggaaaatagagaagtatagtaccgacatcctgggaaatcagtttaaagtgaagcctagcaaatctccccagttaattttcaagaggggtgtgctctga

SEQ ID NO: 2656 - RNA, 3180 nt, synthetic construct
  misc_feature 1..3180: note = Cas9 variant
  source 1..3180: mol_type = other RNA
atgagaaggctgggcctcgacatcgggaccaacagcattggatggtgccttacacagggtcccggcgatgaggccgacgggatagtggatatcggagtccggattttctccgacggccgcgatcctcaatctggtacttcactggctgttgaccgacgtgatgcaagagccgcgaggcggcgcagagacaggtacatcgggcggcgcagtgcctttttggatacgttagtggcccacggactgatgccagcagacgccgatgaagctaagctagtagcagccctcgacccgtataccctgcgagctagagcccttgaggcgcccctgacacctcatgaaattggcagggcattgttccacctcaatcagcggcgtggctttaaaagcaaccgcaaggccgagagaaaaactaatgatgctgacgacgggaagatcgccaccgcagcttacgccctggatagggcgatgctggacggaggtttcgatacactcggccagtttttaaacgcccaggaaaccaaacgggtgcgaatggacggggaggcacaaggatatgatttctacccacagcgcagacatgtcgagtatgaatttgacaggatatggactgagcaggctaagcaccatcccgccctgcttacagaaaccgctcggtacgccttgcaccgcatcctgttctatcagagacctctaaaggcacaagtggttggcaaatgtacgtttgtgcactccgaggataggctcgccaaggctcatccactgttccagcagcgtcggctttacgaggaagtcaatcagctggaggtgactacccccggtgaagcgaaccgaaaattgacactcgacgagagagataggctggtacgcgaattatctcacaagaaagcaattgcctttacttcgctggctgccaagatcaagctcgagcctgggcaatcattcaataaagcaagcgagacccggacacagcttgccggagacgaagttagagctgtgctgggcgataagaaaaggtttggcccagcctgggagcatttcgaccgcgaccgacagtggaccattgtcgaacggttgctagaggaagaggatccggacgcactgcacgcgttcctcacgcaagattgcgggctggacgatgagcacgctgccgcaactgccaagacaagtcttcccgaaggatacggtcgtctgggcgctaccgccactgcaagaatcttggctgagctccaggccgaagtgataacatatgacgaggcggtgaggcgctgtgggtggcatcactccgatcatcggaccggagaaattctgcctcagttaccatactatggcgagctgctaacgagagacattccccctggtacccaggatccaaacgatcccccggagaaaaggtgggggcgaatcacaaatcctactgtccacatcggcctcaaccaagttcgccagctggtgaatgccatcgtagctgtgcatggacggcccgaccagattgtcgtggaacttgcaagagagttgaagctgaacgaaaaagacaaggaggagcacaataggcgtatacgccgggataccgccgctgccatcaagagatctgaaaaactcacacaggagggctttccagacactggggcaaacaggatgctgcttcgactgtgggaagacttgaatcctgcgaaccccctcgatcggcgctgcccatactgtggagcccccattggtatgagagctctgttcgccggcgaggcagacgttgatcacatcataccttatagcaggtccttagacgattcagctgggaacaaggtggtcgcccatcggagttgcaatcgagcaaaaggaaacagaaccccatacgaaaagtggagcgacgatccggaccgctgggatgccattacagctcaagtggcgaggctgcaccgttctaaacagtggcggtttggccccgacgccatggcaagagtagagaaggatggtgggttcctatccaggcagctcaccgacactcagtatctgtcacgccttgctggccgatacttgagcagtctgtaccctacgaaggaggaaggatctgtttatgtgatcccaggcagaatgacagccatgctccggaggctgtgggggttaaatgatatcctgtccgaccataacattgtcgagaataaacacagcaacgcccccaagaatcgccttgaccaccgtcatcacgctatcgatgcagccgtggtcgcggtgtcgaccagatctttgatgcaacggattgctaggactgccggacaggcagaagaccgcaacctcgatcgactgtttgagggtctagaccctccatggcccggcttcagagatcagctgcgggacaggctcctggccgttaccgtgtcccataaagctgatcacgggcgcacaggaaccccggtacctggcaaggacgcaactgccggtagacttcataatgatacagcgtacgggttgacgggcgaaacctcagctaaaggactgccaatagtcgtgcacagggttcccttaacaagtctcaagcctgccgacatcactgatcccgaccggattccagaccctgtgctgcgtgatgcaatcgagcgcgccaccgctggcaagatggggaaagactttacagatgcccttgcaaagttcggacgaagcggcgctcaggagactgacagaaaaggtgaaaggctgtttcgggggacccgcagagtcagggtgcgggagcccttgggagtaatcccaattgccgatgcgtccggccgagtgtataaggcctacaaaggtgactctaacgcaagattcgatgtttggcgcctcccggacggcaagtgggtcagcgatatagtgtcaatgtttgacgctcacaggcctgatcaaggggaccggcgtccccatccagccgctaagaaagtgctgagtctaagacagaatgatatgatcgcaattgaaagggacggagctccccgcgagatcgtccgggttgtgaagttctccacgattggcagcgtgcagctggccgctaccacagaagcggggcctctcaaagcacgagacgcctctccacccgatgtagacccttttagatatatcaactcaagtgctggaggcctgaagaaaataaaggccaggcaagtccgcatcgatccgcttggtcggattttcgacccagggcccagatga

SEQ ID NO: 2657 - RNA, 3180 nt, synthetic construct
  misc_feature 1..3180: note = Cas9 variant
  source 1..3180: mol_type = other RNA
atgatcgagaggattctgggcgtggacctcgggataagctcccttggatgggccatcgtcgaatacgataaggacgatgaggctgcaaacaggattatcgactgcggtgttcggctgttcaccgccgcggaaacacccaaaaagaaagagtctcctaataaggctcgccgagaagcccgtggcattagaagggtgttgaaccggcgcagagtaaggatgaatatgatcaaaaagttatttctgcgggcagggctaatacaggatgtggacctcgatggagagggcggtatgttctattcaaaggccaaccgcgctgacgtctgggagctgcgacacgatgggctttacagactgttgaaaggagacgaactcgcaagggtgctgatccatattgccaagcaccggggctataaatttatcggcgatgacgaggctgatgaagagagtgggaaggttaaaaaggccggagtggtcctgcgtcaaaatttcgaggcggcaggttgtcgcactgtgggcgaatggctctggagagagagaggggccaacggaaagaaacggaataagcatggcgactacgaaattagcatccaccgagacttactggtagaggaagttgaggctatatttgtggcccagcaggagatgcgctccacgattgcaaccgatgctcttaaagccgcgtatagagaaatcgccttctttgtcaggccaatgcagcggattgagaagatggtgggtcattgcacatacttcccggaggaacgcagagcacccaaatctgctcctactgccgaaaagtttatcgctatctcgaaattcttttcaaccgtgattatagacaacgaggggtgggagcaaaagatcattgaaaggaagacattggaggaactgctagatttcgccgtcagccgtgagaaagttgaatttcggcacctccgaaagttcctggaccttagtgataatgagatcttcaaaggactgcactataagggcaaaccaaagaccgcaaagaaaagagaggccactttgtttgaccccaacgaacctacagagctcgaatttgataaggtggaggctgagaaaaaggcgtggatatccctgaggggcgcagccaaattacgcgaagctctggggaatgagttttacggacggttcgtagccctcggtaagcatgcagacgaagccaccaagattcttacgtactataaagatgagggccagaagagaagggaactgactaaattgccactagaggctgagatggtggaacgcctggtcaagatcgggttttctgacttcctcaaactgagccttaaggccatccgagatattctgcccgcaatggagtccggagcgcggtacgacgaagctgtgttgatgctcggcgttcctcacaaggagaaatcagccatcctgccaccgttaaacaagaccgacattgatatactgaatcccacagtgatccgtgcatttgcccagttcagaaaagtcgctaacgccctagtgaggaagtatggtgcatttgaccgcgtacatttcgaactcgctcgggagattaatactaaaggggagatcgaagatatcaaggagagtcagagaaagaacgaaaaggagaggaaggaagccgcggactggattgccgagaccagctttcaagttcctctgacacgcaaaaacatacttaagaaacgattgtacatccagcaggatggccggtgtgcttataccggagacgtgattgagctggaaagactcttcgatgagggctactgcgaaatcgaccacattctgccaaggtctcgttccgcagatgactcatttgccaataaggtcctttgtctggctcgcgccaaccagcagaaaacggatcggactccctatgagtggttcgggcacgacgcagcgagatggaatgccttcgagacaaggaccagcgctcctagtaaccgagtgcggactggaaagggtaagatcgatcgcttgctcaaaaagaattttgacgaaaactctgagatggccttcaaagacagaaatctgaacgatacaaggtacatggcacgggctataaagacctactgcgaacaatattgggtctttaaaaattcccatacgaaggccccagtgcaggttcgaagcggcaagttaacctcggtgctgagataccaatgggggctagagtctaaagaccgcgaatcccacacacatcacgcagtagatgccatcattatcgctttctcaactcagggaatggtccagaagctcagtgagtattacaggtttaaagagacccatcgtgaaaaggagcggcccaaactggcggtgccgcttgccaacttcagagacgcagttgaagaggctacaaggattgaaaatactgagaccgtgaaggagggcgtcgaagtgaagcgcttgctgatcagccgacctcccagagcccgggtaacaggtcaggcccacgagcaaaccgctaaaccatatcctaggataaaacaggtgaaaaacaagaaaaagtggcgcctcgcacccattgatgaagagaaatttgaatccttcaaggccgaccgtgttgcgtctgctaatcagaagaacttttacgagactagcacgatcccaagagtcgatgtgtatcacaaaaaggggaaattccatctggtgcccatttacttacacgagatggtcctgaatgaacttcctaacttgtcactcggcacaaacccagaggccatggacgaaaatttcttcaagtttagtatcttcaaagatgacctgatatccatccagacccaaggaactccgaagaagcccgcaaaaattatcatgggctacttcaagaacatgcatggggccaatatggttctaagctctattaacaattcaccttgtgagggatttacctgcacaccagtgagtatggataaaaagcacaaagacaagtgtaagctgtgccccgaggaaaaccggatcgctggtaggtgtctccagggcttcctggattattggagccaggaggggcttcgccctccacgaaaagaatttgagtgcgaccagggagtgaagttcgcattggacgtcaaaaagtaccaaatagatcccctgggctattactatgaagtaaaacaggagaagagattaggtaccattccgcagatgcggtccgccaagaaactcgtgaagaaatga

SEQ ID NO: 2658 - RNA, 3180 nt, synthetic construct
  misc_feature 1..3180: note = Cas9 variant
  source 1..3180: mol_type = other RNA
atgagcaagagactgaggtaccggctcgcccttgacctgggcaccaactccatcgggttctgcttgttagatctgaatggagacggtcgcccctgtggcgtgcgacgtatgggggtcagaatttttcctgatttctctaaactacagcaatcactcgctgcagacaggcggctggcccgcagtatgagaaggcggcgcgatcgatatcttagaaggcggaaggcgctgatgaacgctttggttgccgcagccctcatgccagctgacccgaaagcacgtaaggccctggaggctctggatccctacgaactccgcgccgcggcagtggccggacctttaccagctcaccagctgggcagagccctttttcatttgaatcagaggcggggtttcaaaagcaaccgaaaggcagctggggacgagaatgaagccggaaaggtaaaatccggcatatctgcgctgaaggccgagctagcagcttcgggcgccgggacactcggacagtggctggctgcccgccacgcaaacagacaacccgtgagggcccggcttactggtacgggcgctaaagcgacctattcattttaccctgaacgcgcactggtccatgaggagttccaggccatcagagctgcccaggcaccacaccatcccggggtgacagccgaacagtgggataggattgagagcgttatctttcaccaacgtcctttgaagccagtgaaaccgggaaagtgcactctctatcccgaagaggagcgggctccttgggccctgccaattgcacagcgattcagaatcttacacgaactgcataatctcaggatagtccgccccggccagggtgaggaagggcttagtcctgcggactttgatcggttctttgacagactgtgtaggaagggagatttgaccttcaaaacactagctaaggagctgaaactcccacccgacgcccgcatcaacctggaagacgataagcgagaccggcttaaaggcgatgcaaccgccgacgctctgtccgccgagaagggcaaacgtagaaggattggggcagcttggcactcttttccggccgatcgccagcgggagatcgtgggaagattgattgacgcggaagatgagggtgaactcgccgcttggctggtagaggaattaggcctgccttgggaggttgcaatcctaactgccgagaggcccgggctcccagacggatactgccgactgagcgaaaaggctcttgagcaagtggtccctttgatgcatgaggaacacctcccctatgatgaagccgtgcgcgcactcggcctgcaccattccgaccaccggacaggtgagttccttgatgagctgccatactacgggttgcccctcgaaagattcatagcgtttggcaccggagaggccgacgaccctccagaactgaggattggccgtttcccgaatcccacggtgcatgtcgctttaaacgagctgcgccgggttgtgaatagaatcattaggcgatgggggaagcctgaggaaatcgtagtggagctagcccgggatctcaaacagtcacgcgcagacagagataagactcagagggaacaagctgacaaccagaaaaagaattggacccggacacagcagctgcgagagcttggaatggaaccaactggtgaggccttgctgagactccgcctgtgggaggaattacccaggatcggcagtgcacacgtctgtgtgtataccgggcaacctattagcatgacacagctgcttcagggagatgttgacgtggatcatatattgccattttctcgtaccctcgccaacggcgctgacaataaaatcgtctgccaccggagagcgaacaggattaagcgcaaccgaacgccctgggaggccttcggtgtggtatccgcagatgggtacgactgggctgccatcgccgaaagagctgagtcactgccgaagaataaacggtggaggtttctacctaacgcaatggaacgcttcgagactgagcgtggctttatagatagacagctggttgaaacacggcacctcagcagggtggcccgcgagtatctgggatgtattgtcccacttgaaaaggtgcgagcggctcccggcagattgaccgccatgctgcgggggaggtggggattaaatagtatcctctctgacgcaaacctgaaaaatcgctccgatcatagacaccatgccgtcgacgctgcagtgcttggtgttatcgaccaaaggctggtgcagcgggtagccgatgcggctaagcgtgccgaggaaaaagagttggagaagctgttcgacggcctgcctgatccctttgaagggctaccaggacctagcttccgcgaccaggtccaggagcgagcacaaggcattatcgtgtcgcacaagcccgaacacggttggcaggggagaatgcataacgatactgcctacggcccagttgagaggctgccggacggaacacaccgggtggtcacccgcaaacctctcggctctctggctgagaaggattttgggaatattagagacagggcccttgcagctgccttggaacggcatgtggcggagcaggccgcacagggacgatccctgggcgaagctctttcatgcttcacgtggaccggtggggaggtaagacgcgtgaggatgctcgataaactgggaagtcccgttgccgtccaagacgatgacggccacacatttaagttatataaaggtgatagcaacgcttggtacgaaatactgcgggacggccgtgggagatggactggaaggatcgtgtccacctatgaggcataccgcctacatgccgagtggctcgccgaacggggcgacgggggacgatctgatgctgcgttcccagactgggcagccagaaggctgtgtgctggcattggtaagcccttgttccgcctgtttaagggggatatgttagccttcggaacagcacctaatcgggagatcatgaaagtggtcaagtttagcgaaggcagaatcgttttcgccggtcaccgtgaggctggcaacctcaaagaaagggacgcggataaggacgatccatttaaataccggacttgctcacccgaggccctgcgcaaggcacaggctcgacctgtgggggtggacccggccggattcgtacacgatagaggcccacttgagtga

SEQ ID NO: 2659 - RNA, 3180 nt, synthetic construct
  misc_feature 1..3180: note = Cas9 variant
  source 1..3180: mol_type = other RNA
atgggcatcagattcgcctttgacctggggaccaacagcattggatgggctgtgtggaggacaggtcccggcgtcttcggggaggatactgcagcctccctcgacggatctggcgttcttatatttaaggatggtcggaatcctaaagacgggcagtcactggcgacgatgcgccgagtgccacgtcaaagtagaaagaggcgggatcgcttcgtattgagaaggcgggacttactggctgccctacgcaaagcaggactctttccggtggatgtcgaagagggccgaagactggccgctaccgacccctaccaccttagggcaaaggccctggatgaaagtttgacacctcatgagatgggccgggtgatcttccacctcaaccagcgtcgcgggtttagatccaataggaaagctgaccggcaggatcgagaaaagggaaagattgccgagggttctaaacgcctggcggagactctggcagccaccaactgcagaacactcggcgagttcttatggtcgaggcatcgggggaccccacgcactagatcacccacaaggatccgtatggagggagaaggcgctaaggccctgtatgcattttaccctacccgggagatggttcgagctgagttcgaaagactttggacggcccagagcaggtttgcgccagacttgctgactcccgagcgccacgaagagattgccggtatcctattccggcaaagagatctcgcacctccaaaaatagggtgttgcacctttgaaccgagtgagaggcgcctgccccgagcccttccttccgtggaggctcggggaatctatgaacgtctggctcatttgagaattacaactggcccagtctctgacaggggcctcacccgccccgagcgggacgtgctggccagcgcattactggccgggaagtccctcacattcaaagctgtaagaaagacccttaagatcctgcctcacgcgttggttaatttcgaagaggcaggagaaaaaggtctagatggcgccctgacggctaagctcctgtcaaaaccagaccactacggggccgcatggcatggacttagttttgccgagaaggatactttcgtgggcaaactgttggacgaggctgatgaagagaggctcattcgacgcctggtcacagaaaaccggttaagcgaggacgccgcaagaaggtgtgcgtctatccccctggctgatggttatgggcgtctaggccgcaccgccaatactgaaatactcgcagccctggtggaggagacagacgaaaccggaacggtggtcacctacgctgaggccgttcggagagcaggcgaaaggacagggcgaaactggcaccattccgatgagcgggacggagtgattcttgatcgcttgccgtattacggtgagatcctgcagagacacgtagtgcctggctcaggggaacccgaggaaaagaatgaggctgccaggtggggacggctcgcgaacccaactgtccacattggcctgaatcagcttcgaaaagtggttaacagactgatcgccgctcatggtcgccctgaccagatcgtggtcgaattggcaagggagctcaagctgaatcgtgagcaaaaggaacggttagacagagagaacaggaaaaatcgcgaagagaacgaacgaagaaccgccattctggctgagcacgggcagcgggatacagccgagaacaagataaggctacgcctctttgaagaacaggcacgtgcgaatgccggcatcgctctgtgcccctacactggtagagccattggcatcgcagaacttttcaccagcgaggtggaaatagaccatattttgccagtaagtctgacactcgatgactctctggctaaccgggttttatgtaggcgcgaggccaatcgagagaaaagacggcagaccccctttcaagcattcggggccactcctgcttggaacgatatcgtggcgagggccgcaaagctgccaccgaataaacgctggagatttgaccccgctgcccttgaaaggttcgagcgggaaggaggatttttgggccgtcagctcaacgagacgaagtatctgtcccgcctagccaagatctacctggggaaaatttgcgatcctgaccgagtctatgtgacaccaggaaccctcactggcctgcttagagctaggtggggtttgaatagcatcctgtcggattctaacttcaagaatcggtccgaccaccgccatcacgcagtcgatgccgtggttattggggtgttaaccagaggcatgatacagaggatcgcgcacgacgctgcccgggcagaggatcaagacctcgaccgagtatttagagatgtccccgtgcctttcgaagactttcgcgatcatgttagggagcgggtgtcaacaattaccgtcgccgtgaaaccagaacacggaaagggcggggctctgcatgaggacactagctacggacttgtacccgatacagacccgaacgcagccctgggcaatttggtggttcgtaaacctatcagaagcctcacggcgggtgaagtcgatagggtgcgcgaccgggctctgcgagccagactaggggcactggccgctccattcagggatgagtccggacgcgtgcgggacgccaagggcctcgcacaggctctggaggccttcggtgcggaaaacggcatcagacgtgtcaggattcttaagcccgatgcctctgttgtgaccatagcagaccggcgcactggggtgccttatcgagctgtagcccccggagagaatcaccacgtcgatatcgtgcagatgagagacggcagctggagggggtttgctgcatcagttttcgaagtgaaccggccaggatggcgccctgagtgggaagtcaaaaagttgggcggtaaactggtgatgagattacataagggggacatggttgagctcagtgataaagacggacagaggcgagtgaaggtagtccaacagattgagatctccgccaatcgggtgcgtctgagcccccacaacgatggcggtaaacttcaggacagacatgccgatgctgacgatccatttcgctgggacctggcgacaattccgctactcaaggataggggctgtgtggcagtccgggttgaccctatcggggtggtaaccctgagacgctctaacgtgtga

SEQ ID NO: 2660 - RNA, 3183 nt, synthetic construct
  misc_feature 1..3183: note = Cas9 variant
  source 1..3183: mol_type = other RNA
atggccgtgaaaagcctgaactacatcctcggccttgacctggggattgcttcctgcggatgggcagtcgttgagatggatgaacaggagaatcccttgagattaatagacgtgggtgtaaggaccttcgaagaggccgaaaaccctaaagatggatcttcactggcggagacacggcgcctagctcgagcccaacgtagactcatcagtaggcgggcaaatcgcatgaacaagctgagaaggcttctgaaacaggagaatgtgttgcaggccaacgactatgatgaaaaggggctcattatcggactgccaaatcaggcttgggagctgcgggcacaaggcctcgaccgcaaattagaaccgaaggagtgggccgctgtcctgattcaccttgtgaagcatcgaggttacttgagccagagaaagaacgagtcccagactgccgataaggaactgggggcgctactctctggaatgaatcacaaccatcagctgcttcaatcgcagtcaaatcagtataggacgcccgcagagctggccatcaaacagtttgctacccaagacggccacatacggaaccagcgtggcgcctacacacatactttcaatcgcttggatctccagaacgaactgaatcaattatttgacgcacagaccagactggggaaccctcacgttagcggaagtctcaagacagctatcaacgatcttctgatgaatcagaaagccgcgttgtccggtgacgccattctagagatgctggggaggtgtaccttcgaaccatctgagtataaggcagctaagaacacttacagcgccgagcggtttgtgtggctcggcaaactgacaaatcttcgaatccaggataacggactggaatccgctttgtcacgcgagcaaagagaactcctgttaaatgagccctataacaagaccaaactgacgtaccagcaggtcaggaagctactccggctgcctgaaactgccttctttaaaggccttcgctacggtaaggacaatgcagagagtgccaccttgatggagatgaaaagctatcacgctattagaaagtctctggaaaacaagtccctcaaatcagagtgggaaaagctgaaaacacagccaaaacttctggacttgatcgggactgcgttcagcatatacaaaaccgatgacgagattgcaggatgcctcaagaatcaactgcccgaaaacgtgatcattgccttacaggagcagctgaattttagtaacttcatggagctatctctcaaggctctggaaaaacttttgcctctgatggagcagggcctcaggtatgatgaagcctgtacacaaatctacggcaatcgtcatgagaagatcgcagacaaaaccgagaagtttctgccaaacattccggccgataaattacggaatcccgtagttctgcgaacgcttactcaggctagaaaggtgataaacgccatcattaggcgctatgggtcccctgcacgggtccacatcgaaacaggaagagaggtgggtaagagcttctcggacagggataaattgaagaaacagcaggaagagaaccaagaacagcgccgacgggcgatagacgagtggaagcagtttttcccaaatgctgcccatgagcccaaagcagtggatattctcaagctgcgtctataccaactgcagcagggcaagtgcctctattctgggctgcctatcgacgtcagaaggcttccagaaaaaggatacgttgagatcgatcacgccttgcccttctcccgcacctgggacgactcatttaacaataagattctggtgttagctagtgaaaaccagaataaaggcaaccaaactccgtacgagtatctccggggtgccgataatagcgaatcctggagactgttcgtagagaacgtgcagaattgtcagttttctcctaacaagaaacagaagatcatggcaaaacaacttgacgagaaggggttcctggaaaggaatttgaacgatacacgatacgtcagccgctttctctgccagttcatttcagagtatctgcacctaaccggcaagggcaaaaagcgggtgtttgctagtaatggccagataacggccctgctcagagggaggtggggactgtccaaaaaccgtgaagagaatgaccgccatcacgcggttgatgccgtggtcgtggcttgtagcaccgtagcaatgcagcaaaagatcacacagttcgttcggtaccagaaaggtaacgtgtttactggcgaaagaattgacaaggagaccggggaggtcatctctatccatttccccacaccatgggaacactttagggaggaagtgatgattcgagtcttcgatgacaaccctcttcggactttgcccgagaagctgccaaatcgccccgaggccttacatgaatatgtgatgcctctctttgtttcaagaatgccaaccaggaaaatgacaggacaaggccacaaggagaccataaaaagtgctaagcggctggatgaaaagatcagcgtgcttcgagtaccgctgactcagctaaagctcaacgacctggagaatatggtcaacagagaacgcgagcccgccttgtacgaggcactgaaggcgaggttagaacagttcaaaaatgatcctgccaaggctttcgccgagccatttttcaaacagggtgggcaacaggtgaaggcagttcgtgtggaaattgtccagaaatccggcatgctcctgcggaagatcaacggagtggctgacaatggctctatggtaagagtggatgtttttgagaagtcggggaaattctatcttgtccccatttacgcctggcaagtggcagaaggaatcctgcctaaccacgccgtggtccatagcaaggacgagtccgactggatattgatggatgagtcataccactttaaattcgctctctataagaatgacctgctagaagttcagacgaaaaagggttgcatcatgggctactttgcgagtctggatagggccacaggggcaattaccatccgcgagcatgaccgagataaaaagaagtgtaaagacggagaacacagatctattggcgtgaagatggctagctccttcaaaaagctccaggtggatgagcttggtaaaaacatccacgaaactcggtcaaggaagcgcccaaatatagggtga

SEQ ID NO: 2661 - RNA, 3186 nt, synthetic construct
  misc_feature 1..3186: note = Cas9 variant
  source 1..3186: mol_type = other RNA
atgcacaccctgccctacacactcggccttgacatcgggattgccagcgtgggagctgcactgttgtccgatgagtctatattaggtatgcatgtcagaactttctcagccgcggaaacggacaaggagggcgatcctctgaacaaaatcaggcgggaagctcgcagtgcccgacgtagaattaggcggcgcgcacacagactactcaggctgcggcgccttctgaagcgaaccgggttgatcagcgacacatccctcgaggttctgaaaacttctaagaccccatggcagctgagatcggaaggactcgataggttactgtcaccgagcgagcttgccgctgcattgtatcatattgtgaaacaccggggctttcaaagtaatcgtaaggccgagctgaagacagacgctaaagccggtcagatgctatccggggtatctgcgaaccagcagctcatgcgcgataagagctacagaaccatcgcagaaatggtgtgcaaagacgatgccttcaaggaccataaaaggaataagggaggctcctatcggaacacttttgctcgatcagatctggccgacgagcttaagacactgttgaaaaagcaacgcgaatacgataatcccctcgcaacccctgagctggaggaagctgtccacacgttactgatggccagaaggccagtgttcaaagacgacgatatagagaagctcgttggcttttgtactttcgaacacggggagaaacgggcgcccaaggccgcatttagtagcgaacgcttcatctggcttggaaaactgaacaatttgagactaatttatcctggtgagcagaggtctctgaccccagaggaacgttcccagatcattaacctcccctttacacaggcttcagtgaagttcagccaaatccggaagaaactggaccttcctgagtacgtccgatttaatctggtgagatataagccaggcgaagagactagcaaatctgaaaccgccacattctttgaggctaaggccttccatgagttgaggaaaacctaccgcgaatccgggataagcgagctctgggaacgggatcagcacgacccgcagagactggatcagattgcaacggccatcgctgtatacagggacgatgagcgcattcgaaacgaattatcgccccatactatcgagaatgaggttgtggaagcggtcctgaactgcgacttcacacaatttatcaatctatctctcaaggcactgaacaagattcttccttatatggagcagggacagcggtacgatgaagcctgtacctccgctggctatcaacaccactcaccacagcagaatgaggagaaaagtggtcgtataccccctccagacaagaacgtgatcagaaaccccgtggtctacaggagcttgaatcaggcccgcaaactgattaacgcaatcactaagcggtatggggccccggctgccatacatctcgaaatggcaagagatctgtccaaacctttctctgagaggaagagtattgaacgagagcaagaaaagtaccgcaaacagaaggttcagcttcggaatgagtatatcgagcactttggaacagaacccaacggcctgaatttgctcaaattcagactgtacaaggagcaggacgcgcaatgcgcttacacccagaaagccttagacctgtcaaggctaaacgaagcaggctatgtggaggtagatcatatcctcccatacagtcgttcctatgacgatagcctgcttaataagacgttggtgctgaccgaagccaaccgcgacaaggggaatcggacaccttttgagttcatgggaggtgatgaccagtctcagcactggcaaaaatttgtcagatgggtgcagatgaaccccaagattaggcaggctaaacgaaatcggtacctccgcaaggatttctcagagaaagccgcaagagaatttagggaccggcatctgaacgatactcgatatatcggcagagagttaaaggctatgattgaaagtcacgttcagtggcacccagacagcaaatccaaggattgttgcgtggtcctgtctgggcaacttaccgccttgctccgcggaaggtggggcttcaataaggaccgtgcggccggtgatctgcatcacgctgtggacgcagccgtagttgctgccgcaacacgggggatgatacagagaatggcgaggcattcgaaatttcacgagctaaagaacgtgcgcactagctacgccgaccccgataccggcgaagtcgtgaatctggctgccgcacgagacctcgagaaacacttccctctgccatgggataactttagaaacgacacacttgcttatttgaatccgtccgccatctcagcagatgagagtgcccaggaaggacatcggggcgtcagggtgtctcgcgctcccacccgtagaaagctgggggcggcccaccaagagactattcggagcaaaggaaaggacaacatcttactcgaacagggtctgtccgcagttaagacgcctctttcaaaactgacattgaagaatatcgagaacatggtgggctacgaggatccaaggaatgctgccctcgtaaaagtcctgcgcgaacgactagaggccttcgggggagacggcgctaaggcattcgcccccaaccagcctccagtgtacaaacccagcaagccgggtaagcaggcgcctgaaattagatctgttaaaatggcttccaagagtaaaggggccctgcatgtgcgggagggcctcgcagatagcggaaggatgatacgcatcgacatttatgaaaccaagaatggctacgtcggggtgccaatctatgtatctgataaagccagatccaagctgcccaaggcttaccctaaaaagggagaggacagggcaaactggcccgaggtggatactaatgacaactttcttttctcattgtatagtaccgactggattgaagccaaaacaaagaaagagaccatcgcgggttacgttaagagctatgatatatttgacggccggctgttagtctacgctcacgataataaaaaggtggtgcgtaagctcactctgtcggcccttgcagacctgcaaaaactacatgtctccatcctcggggatctgtacaagggaggcacaccaaaatgttctcctttgcgcaagggtcaggaactgtga

SEQ ID NO: 2662 - RNA, 3186 nt, synthetic construct
  misc_feature 1..3186: note = Cas9 variant
  source 1..3186: mol_type = other RNA
atgctgagactcggccttgacatcgggagcacctccattggatggttcctgtacaggataacaaacggtatgatcgccgagattatcgattgcggcgtgcggttgttttctgacgggcgcgatgctaagactggagtctcaagtgcagttgaacgacgtaatgccagagcgttaaggcggcgcagagacaggtatctgcggcgccgagctgccctaatgagaaggctcgcagccgctggcctgatgcccgaggatcctagccaggcaaaaccacttgaactgttggacccgtaccggctccgtgccgatgctctggaccgcagactggagctcacggaattaggtagggccctgttccaccttaaccaacggcgagggtttaagtccaatcgccagaccgatagaggaaacaatgagggcggcaaaattatcgacgggtctgcgaggttggatcaggcaatgatggccgtgggagctcggacatatggtgagttcctgcatctacgcagatcgcaggccgaagacctcaggcgtgtaccctcagtgcggactcgactgacccttagaagcgtcgatggcgggaaggcagagacaggatacgacttttatcctgacaggcgccacctggaagaggagttcaacaaagtgtgggctgcccaagcggcccatcacccagttttgaccgatagtctccggcatgaagtgtttgagactatattctttcagagacccctgaaggctcctgcagtcggtaggtgtttattctttccagaaccccgcctgcctcgagcccacccactcacacagcggcgtgtgctttacgagaccgtaaatgctctgagaatcaggacggaatccggcgccgcagttccgttggggaaggagcagcgcgacaaagtgattatgctactggatggaaaggcccccgtcaaagctatcgcgtctgcaaagctcagcctgaaagccattgctaagcaccttaagctgcgggacggccaaactttcaccttggagaaaggcagagattatatcgcctgcgaccctgtgagggcatccctctcacatccagatcgatttgggccccgctggagtgtgctggaagccgaggtccaggctgaaatagttggacggattagagacgatgacgatacaatggccttagtggagtggctgaagcaggtacacggtctagacgacgcacatgcgagggctactgccgatgcacctctcccagaaggctacgggcgtctgggagagaccgccacacgcaaacttttggactgtctgaaggctgaggtgctcacctacagcgaagccgtcggcaaagcactggatcagcaccactctgaccggagaacgggtgagatccttgaatccctgccctattacggggaggtgttgcaagctcatgttattccgggcactggagaacctcaccatgatgacatcacaaggttcggccgaatcaccaaccccactgtgcacattgggctcaatcagctgcggcgcttagtcaacagaataatcgccaggtatggaaagccagcggagattgtggtagagctggcccgggatctaaaacagtcaacaggtcaaaagaaggctgcaatcgccctcaatctgaaaaaccgaaaggctgccgaagcaagaagcgcgcttttgaccgagtggggcgttcctgacacgggggccaatcgcatgtacgtgaggctgtggcaggaactccatgaggatcccatgatgcgtcggtgcccatataccggaacaataattagtccctctctgttattctccggcgctatcgacatcgatcacattctgccttacagcagaactcttgacgattcgaccgccaacaggacattgtgtatgaaagaggcaaatcgccagaagcgaaacaaatctccatccgaagctagacgggacggtatgaggatctgggccctcgaggacgataacctgcgccacattccggaatttaagcgttggagattcgcagaggacgccatggctcggtttgaaggggagagggatttcgaggcgcgcgccctagtcgacactcagtatctgtcacgaataagtaaggcatacctcgaaaccctgtacgatggcgctgacggaaaaagccatgtgtgggtcgtgcccggcagacttacagagatgttgcggaggcactgggggctgaatggaatcttaaccgatcctctccgcgacgttactaaggagaaaaacagaatggatcataggcaccacgccattgacgccgctgtggtagcagccacggatcggggtctgatcaaggcgatggctgaacaagcccgtacagacgtcgatcagggccgcgaagcacttgcctcctctatcatgccaccctggcctgggtttcgagaggctgtggcagcccaggttgacagaattatagtgagccataggccagaccacggacggatcgatctgaccactcgcatgaaaggcagagaccagaccacaggtcccttgcatagggataccgcgtatgggctcactggccaatcagagaagggagtcccgctggtggtaacacgggaacctttcgacaatctaacgccaaccatgattggcaagatccgagatgagcccctgaaagctgccctcgcagccgtgactgctgggaagaaagacgatgcctttgcagaagctctggcccacttcagagaccgccctggaccctaccatggcattaggcgggttcgtcttatcgagccaataagtgtcgtggaaatcagagatgcgtccggtagggcctataaggggtacaaaggaaacagcaatcactgctttgaggtgtggcgcttgcctggcggtgcaattacagagcacatcgtctctaccttcgacgctcatcagcccggcccagaaccgcggcctcaccccgccgctaagcgactgttaagactctttaagtcagatatggttaaactggacgacagtaagttcgggccagtgattgcaacagtggtaatgtttgataggaacggaaaaatcagccttgtcccccatactgcctccaatgcccgcaagcggtgtgagaaatataaggaagacctgtacctaagattcaccgctcgtacgctcatagaggcgggcgcaaggcggattatcgtggatgagaccgggcacttccgcgaccctggacgaaaaggctga

SEQ ID NO: 2663 - RNA, 3189 nt, synthetic construct
  misc_feature 1..3189: note = Cas9 variant
  source 1..3189: mol_type = other RNA
atggccgagaagcagcacagatggggcctggacatcgggaccaacagcattggatgggctgtgatagcactcatcgaaggtaggcccgccggccttgtcgcgacagggtcccggattttctctgatggacgcaatcctaaagacggctcaagtctggctgttgagcgacgtggtccaagacaaatgaggcggcgcagagataggtacttgcggcgccgagacagatttatgcaggccttaatcaacgtggggctgatgccgggagatgcagccgctaggaaggccctagtaactgaaaatccctatgtgctccggcagcgtggcctggaccaggcacttacgctgcctgagttcggccgcgctttgtttcatctcaaccaaagaagggggttccagagcaatcggaaaaccgatcgagccacagcgaaggaatccggaaaagtcaagaacgcaattgccgcttttcgcgccggtatgggcaatgcaagaactgtgggggaggctctggccaggcggctggaggacggacgcccagttagagcgaggatggtgggccagggtaaggatgaacactacgagctctatatcgcccgtgaatggatagcacaggagttcgacgctttatgggcctctcaacagcggtttcatgctgaggtcctggccgatgcagcccgagacagacttagggctatcttgctgttccagcgcaaactactccccgtgcctgtagggaagtgctttctggaaccaaaccagccccgggttgcggcagcccttccttcggctcaaagattcaggctgatgcaggagttgaatcacctccgcgtgatgaccctggccgataaacgagaacggccattatcatttcaggagcgtaacgacctgctcgcacaacttgtcgccagaccgaagtgtggattcgacatgctgaggaaaattgtgtttggcgctaataaggaagcctaccgcttcacaatcgagagcgagcggagaaaggaattgaaaggctgcgataccgcagcgaagctagctaaagtgaacgccctggggactaggtggcaggcactcagtctggacgagcaggatcgacttgtctgtctgttgctcgacggagaaaatgatgccgttctggctgacgccttacgcgagcattatggtctgacagatgcacagattgacaccctactcggcctgtccttcgaagatgggcacatgcggcttggaagatctgctttgctgagggtgctcgacgccctggagagcggccgtgatgagcaaggtcttcccctgtcctacgacaaggcggtagtggccgctgggtatcctgcacacacggccgacttggaaaacggcgagcgcgatgctctcccatactacggagaactgttatggcggtatactcaggacgcccccaccgcgaaaaatgatgcagagagaaagtttggcaaaatcgccaaccctacagtccatatagggctgaaccagctaaggaagctcgtgaatgctctgattcagcgatacggaaagccagcccaaatcgttgtggaacttgcacggaacttgaaagctggtctggaggagaaggaacgcattaaaaagcagcagactgccaatctcgagagaaacgaaaggatccggcagaaactgcaagacgcaggcgtccccgataatcgagagaacagattacgcatgaggctgttcgaggaacttgggcagggaaatggcttgggtaccccgtgcatctattcagggcgtcagattagtctccagcggctgtttagcaacgacgtgcaagtagatcacatactacctttctctaagacactggacgattcctttgccaataaggttctcgctcagcatgacgcgaacagatacaaaggcaataggggacccttcgaggcctttggcgcaaaccgcgatgggtatgcttgggacgatatccgagccagagccgctgtgctgccacggaataagaggaaccgcttcgcagaaaccgccatgcaggactggcttcacaatgagacggactttttggcgcgtcaactgactgatacagcttacttatcaagagtcgcccggcagtatctcaccgcaatttgtagcaaagacgatgtgtacgtcagtcctggaaggctgactgccatgcttcgcgctaagtggggtctgaaccgagtgttggacggcgttatggaagaacaggggagacccgcagtgaaaaaccgggatgaccacaggcatcacgccatcgatgcggtagtcataggagctacagaccgcgccatgctccagcaagtggcaaccctggccgctagagccagggagcaggatgcagaacggctaattggcgacatgccaacgccctggcctaatttcctggaggatgttcgtgctgccgtggcgcgctgcgtcgtgtctcataagccagaccacggtccggaagggggcctccataacgataccgcctacggaatcgtagcaggcccctttgaggacgggcgatatagagtgaggcaccgggtttccctgttcgaccttaagcctggagatttgagcaatgtccgctgtgacgctccactgcaggccgaattagagcccatctttgagcaggatgacgctagagcaagggaagtggccctcacagccctggctgagcggtaccgacaaagaaaagtgtggcttgaggagctgatgtcggtcctacctattcgcccaaggggcgaagatggtaagactctccccgactctgcgccgtataaagcatacaagggggattccaactattgctacgagctgttcatcaatgagcggggacgttgggacggcgaattgatttcaaccttcagagccaaccaggctgcctataggcgctttcggaatgatcctgcacgattcagaaggtacacagccggtggccgcccactgttaatgcggctctgtataaacgactacatcgctgttgggactgcggccgagagaaccatttttcgtgtggtgaaaatgagtgaaaataagatcacactggcagagcacttcgagggaggcacccttaagcagagggatgctgacaaagacgatccctttaagtatctgactaaaagccctggggccttgcgggacctcggagcacgccgaatcttcgtagatctgattggcagagtcctagaccccggtataaagggggattga

SEQ ID NO: 2664 - RNA, 3189 nt, synthetic construct
  misc_feature 1..3189: note = Cas9 variant
  source 1..3189: mol_type = other RNA
atgaacctgaattacatcctcggacttgacctggggattgccagcgtgggatgggctgtcgttgagatagatgaacaggagaacccccaaagattgatcgacgtgggtgtaaggaccttcgatcgggcagaagtgttaaagacaggcgagtccctggccctagcgcgccgactcgctcgttcttcaagaaggctggtcaaacggcgcgccgaaagaattaagaaagcaaagaggcttctgaaagccgagaatttgctcctgagtgctgacgagatcctgcctaacgaagcatggcagctccgggtgaaggggttagatcagaagctggagcgccaggaatgggccgctgttcttttgcatctgctaaaacaccgaggatatctcagccaaagaaagaatgagtccaaatctgagaacaaggaactgggcgcccttctgtcgggtgtggcgattaatcaccagatcttgcagtcagcagagtacaggactccagccgaaatagctgtcaacaaatttcaggccgaggaagggcatatccggaatcaacgtggagcatatacgcacaccttcagccgcctcgacctgttagctgagatggagctgctctttcagagacaggccacacttggcaacccgcataccagtactaagctgttggaaaatctaacagcgctgctcatgtggcagaagcccgccctggcaggcgaggctattcttaaaatgctggggaagtgcaccttcgaacctactgagtacaaagccgctaagaactcctattctgccgaaaggtttgtgtggttgacaaaactcaataacctgcggatcttagagcaaggagcagagcgagccctgaccgataatgaacgcttcgctctactcgaccagccatacgagaaggcgaaactgacgtatgcacaggtaagaactcttttgggtctgagcgatgaagccatttttaagggcctcaggtaccaaggggaggacaagaaagctgttgaaaccaagacaactctgatggaggtgaaagcctaccaccagatccggaaggcacttgagggactggatttgaaagccgaatggaacgagctcaagaacaatcccgctctgttagacgaaataggcaccgccttctccctgtataagacagatgacgacattcaccgctacctagatggtaaactctcagagagtgtcctgaacgcacttttggagaatctgaactttgacaagttcatccagctcagcctgaaagcgttacagcaaattctgcctcttatgttgcaggggcagagatatgatgaagctgtgtctgccatctacggagaccattatggcaagaaatccgatgagatcgacaggctcctgccaaatattcccaccgatgaaatacgtaaccctgtggtcctacggacgctgactcaggcacgaaaggttatcaatgccgtggtaagactctacggctcaccagctaggattcacatcgagacagggcgcgaagtgggaaagagctatcaagaccggaaaaagctggagaaacagcaggaggaaaacagaaagcagagggagaatgccgtcaaaaagtttaaggaatacttcccgaactttgtgggtgagcccaaaggcaaggatatacttaaaatgcgcttgtacgaactgcaacaggcaaagtgtttatatagtgggaaatctctcgagctgtaccgacttctggagaagggatatgttgaagtggaccatgctttgcctttctcccggacctgggatgacagcttcaataacaaagtcctcgtgctggccaatgagaaccagaataagggcaacgcgactccatacgaatggctagacggtaagaacaattcggaggggtggcagcactttgtagcccgtgttcaaacatctggcttctcctatgctaaaaagcagagagtgctgattcaggaactcgatgagaaatcatttatcgagaggaacctgaatgacacccgctacgtcgcacggttcctttgcaaccacatcgccgataatatgttgctgacgggaaagggcaaaagaaaggtgtttgctagtaacgggcaaattaccgccttactcaggggatgttggggtctgcagaaggtccgagaaaataacgaccgccatcacgcacttgatgcggtggttgtggcctgcagcacaaaatccatgcaggacaagatcactaaattcgtaaagtataaagagggccggctgtttaaggataagaaagacggggtctacaagggagaaagaattaatagggagaccggcgagataatctctctacatttccccacaccttggaaatttttcaaggaaaacgtggagattcgtatctttagcgaaaatccaaaactcgagctggaaaaccgcttgcccgattacccgcagtataatcacgagttcgttcaacctctgtttgtgtcacggatgcccactagaaagatgaccggtcaggggcatatggagacagtcaagagtgctaaaaggttagacaagggcctctccgtgctgaaagtaccacttacccagctgaagttgagcgatctcgaacgaatggtgaaccgggagcgcgaaatggccctgtacgaggcactaaaagaatgtctggagcagttcggaaatgaccctgctaaggccttcgcagagcccttttataaaaagggcggggcccttgttaaggctgtcagagtggaacaaactcagaaatctggagtgctcgtcaggaacggtaacggcgttgcggataatgccacggggtcaatcgtgcgggtggacgtattcacaaagggaggcaaatactttctggtcccaatttatacctggcaagtggcaaagggtatattgcccaacaaagctgttatccaggggaaggacgagagtgaatgggaggaaatggatgagaatgccgtgttccagtttagcatgcacaagaacgacctgattaaagtcaagactaaaaagggcgagatcttcggatactttaatggcttagatcgagccaccgggtccattgaaatcgaggaacacgacctcgagaaatctaagggaaagaacggctcgcatagaggtctgggggtgaaaacagctttctttcttgagaagtatcaggttgatgaactgggcaaaaatatacgcccttgcaggccaaccaagcgtcagcacgtgcggtga

SEQ ID NO: 2665 - RNA, 3192 nt, synthetic construct
  misc_feature 1..3192: note = Cas9 variant
  source 1..3192: mol_type = other RNA
atggagaaccacatcaattacagactgggcctcgacattgggatagccagcgtgggatggtccgtcatcaaccttgataagaaaaggattgaagacctgggtgttcggatcttcaatgctgcagagcatcccaaggatggcagttcattggccttacctcgccgaattgcgcgtgggagaaggcggctgctacgcagaaaggcttatagggtgaagcgggtacgcaaactcatcgtggactacaacatactgaccaaggatcagcttaatgacctgtttaagcaaaaatgccagaacagtgtctgggaaatccgagtgaaggccttggataataaagttacaaacgaggaatgggcaagactcctgattaatctgtgtaagaggcggggattcaaaagcaaccgtaagaatgaggccgacgataaggagactaaaaaggtgatcaactccattaaatctaatatcaagggcatgaaagaatcgggttcacgcacgataggggagtatatttacacccagacactcagcagtggagacatctccaagtcttttagaaacaaagatggccagtataataactgcgtcagcaggaagatgattgaagaggagatcaagatcttattcaaaaagcaacgggaactgggctgtgagtttgcttccgaagagattgaagagaaataccttgcaatattcaactcacagcgaccatttagtaagttcgaggacttggagaaaatggtggggttttgcactttcgaaaaggccagcaaggaacgcagagctccgaaatgttctatctccgccgaggaatttgtactgtatgataatatgaacaagctatcaattctcaataaaggagacaccaggaagctgacaaacgaggagcggaaaatcatagttgaaaatgcgttcaagaacaaggagattaaatacagcaaacttcgcaaaatcctgaatttgagtaacgacgaaagattttctaccctctcctacagcaataagactgagctgtcgaaaacagaaaactctaagttcgtggcattaaagggttatcacgagatcaaatccgccattgagaagtcattcggcaaagatacctggaatagggtcaagaacaatcgtacgatgctgaacgacatcgcttacgtgctcagtattgccaaaactgatgaagacataatcaagcagcttagcctgcggaatattccccgagagatcatcgatgcagtgttggggctatccttttctaaattcagcaacctgtcaattaaggctatagaaaagatcctcccttatctgaaagacggacagcaatacaacgaggcctgcaagagtgcgggctatgattttaaagccacctacaatggtgagaagtcctataaacttccactgattgacatcgatgaaattgtcaaccccgttgtgaatagagcattgagccagacaaggaaggtaatcaacgctgtgatagaccgctacgggtctcctatcggaattaatatcgagctcgcccgggatctggctaagaacttcaaagacagatcaaagattaaaaaggaacaggaggaaaatagggccaacaaagagaagatcaagaatgagttaaaaatgctgatgaacaaggaaccaacttctagcgagatactaaaataccgcctctggaaggaacagcgagaggaatgtgcatattcccaagagcggatttacatcgaggacctgtttaaagtcggccagtatgaaattgatcatatcatacccttctctcgttcgtttgacgatagccttaataacaaggtgttggttaaggccgctgagaatcagagaaaagcgaacaggatcccttacgaatatttcggctccgacgaggatcgctggtaccggtttgaagtgtgggtcgagcaatcaagtctgtctttcaagaaaaagaataacctcctgaaaaagagatttagcagggaggactccattgagttcaaagatcgaaaccttgtggacacccagtatatctcacgctacattagcaattttatcaagtctcggctgatattcaaggaatccgatagtaaacagaaggtaattacaatcaacgggagagcaaccagctacttgagggccaaatggggactcctgaaggttcgtgaaaatggtgacaaacaccatgctttagatgccacggtgatcgcagtcgccactcagggcatggtgcaagagatttctaagtattccaaggctcacgagctgaaatacatccgccagggggacgagttcattgatatagaaacaggagaaatcgtcaaggtgaaagaccacaagcatctatcaaaagaccggctcccagagccgtggctgggctttagtagcgaacttagattgaggctgtcggagaaccccattgaggaactcaagaagtcccctatctctacctatgatgaggagttcattcgaaaaactgttcggccaatctttgtgagccgcgtaccctacagaaaggtcacaggtaggctgttcgaagaaaccgtgtattcacctaaagcctttatagacgaggggttcatcgcaaagaaaaagttacaggatctgacgcttaaggactttgagaatatttacaactataatagtgataaaaagttgtacgacgcgctccgggaacgactggaggaatacggcggaaacgctaaaaaggccttcgcagaggaatttagaaaaccaaccaagacaggcaagctagggcccatcgttaaatccattaaggtgaaaactaagatcccgttcaaagatggaatagacctgaatggtggcaaggtcaaaaaggatgggctcgtgcgcattgacatctatgagaaggagggaaaatactatgtagtgcctgtttacaggctggatatccagcaaggcaacattcccaagaaagccgctgtcgccaataaggaagagaaagactggatacttatggatgaatcttataactttaagttcagcttgtacaagaatgacctgatctatattaaatacgactccaagggtgagtactttgggtattacgatggcttcgaccgtcacaccggagcaatcacattagagcggcatgataactcagaaagatataggggcattgggatcaaaactggagtgaaggagatattcaaatacaatgtggacgtcctcggtcgctattacaaggttgctaagtga

SEQ ID NO: 2666 - RNA, 3192 nt, synthetic construct
  misc_feature 1..3192: note = Cas9 variant
  source 1..3192: mol_type = other RNA
atggagaagttccactacgtgctgggcctcgaccttgggatcgccagcgtcggatgggctgcaattgaaatagataaagagaccgaaacatccatcggtctgttggactgcggcgttagaacttttgagagggccgaagtgcccaagacgggggattctttagcgaaagctcggcgcgaggcccgatcaacccgtagactgattaggcggcgcagtcatagactactcaggctgaagcggcttctgaaacgcgagatcttccgacagcctgaaacatttaaggacttgccaattaacgcatggcagctcagagtaaagggactggatagcaggctgaatgagtatgaatgggccgctgtgctcttacacctggtcaaacatcggggctacctttcccagcgtaagtctgagatgtcggagactgactcaaaaagcgaaatgggtcgcttgctggcaggggtggccgagaaccaccagctactccagcaagaacagtatagaaccccggctgagctggcccttaagaaattcgttaagcattttaggaataagggaggcgattacgcgcacacattcaaccggctggacttgcaggcagaactccacctgttatttcagaaacaacgagagctgggcaatcccttcaccagtcctgagctcgaacgccaggtggatgaccttctgatgactcagagatccgccttgcagggggatgctatcctaaagatgctgggacattgtggttttgagccagaacaattcaaagccgcaaagaacacattttctgctgagaggttcatatggctcaccaaactgaataaccttcggatccaggaccagggcaaggaacgcgccctgacggcggatgagagaactaaattgctcgacgagccctataagaagtcaaaactgacctacgcccaagtcaggaagttactgtccctacctcagacagcaatttttaaagggctccgttatgacctggaacacgataagaaagctgagaatagcactcttatggaaatgaagagttaccataacatccggcagaccttggagaagtctggactgaaaacagaatggcagtctattgccacccaaccagagatcctcgacgctataggcacggccttctccatttacaagactgatgaggacatctcacacgaactgaaaacatgccgacttcccgagaatgtgctgaacgaattgctcaagaatattaacttcgatggttttatccagctgagcttaaccgcactgagaaaaatcctacctctcatggagcaggggtataggtacgacgaggcctgtactcagatttatggaaatcaccatagtggctctctgcaacaggaatccaagcagttccttccacacataccgatcgatgacgtacgcaaccccgttgtgtttcggacattgacccaggctagaaaggtcgtgaacgcgattatcaggcgctacggcagccctgcacgagtgcatatagagatggcccgggaactggggaaatcgaagtctgatcgtgacagaattgagaaacaacagcagaagaataaaaaggaaagggagaacgctgtcgccaagttcaaagaggattttccagacttcgttggagaaccccgcggtaaggacatcctcaaaatgcggctgtatgagcagcaacacggcaagtgcttatactccgggcatgatatcgacattaatagactgaacgaaaaaggatatgtggagatcgatcacgcacttcctttttcaaggacgtgggacgatagtcagaataacaaggtattggtgctcggcagcgaaaatcagaacaaacgaaatcaaaccccagacgagtacctggatggtgccaacaattcccagcgctggctagagttccaggctcgggtccagacatgtcacttttcttacgggaagaagcaaaggattcagctggccaaactcgacgatgaaactgagaagggcttcctggaaagaaaccttaatgacacccgttatatagcacgctttatgtgccagttcgtgcaggagaacttgtacctgacaggaaaaggcaagcggttagtttttgcgagcaatgggggaatgactgctaccctcagaaacctgtggggtcttaggaaagtgcgagaagataacgaccggcatcacgccctggatgcaatcgtcgtggcctgttcaacagctagtatgcaacagaagattaccaaggccttccagcgccatgagtccatcgagtatgtagacactgaaacgggcgaggttaaattcagaatcccccagccgtgggactttttcaggcaagaagtgatgattcgggtctttagcgatcagccttgcgaggacttggtggagaagctctctgcacgacccgaagctctgcacgataatgtcacaccactattcgtgtcaagagcccctaaccgcaaaatgagtgggcagggacacctggagaccataaagagcgcgaaaaggctctccgaagagaatagcatggttaagaagcccctgactacccttaaattgaaggacatcccagaaattgtgggctacccctcgcgtgagcctcaactgtatgccgctttaaaaacacggctcgagacccatgatgacgatccaatcaaggcatttgccaaaccgttctacaagcccaacaagaatggtgaactgggggctcttgtaagaagcgtcagggtgaaaggcgttcagaacactggagtgatggtccacgacggcaaggggattgccgataatgcaacaatggtgcgcgtagacgtgtatacgaaagcgggaaagaactacctggttcctgtctacgtgtggcaagtggcccagggtatcctaccaaatcgagctgtcacctccggcaaatcagaggccgattgggacctcatagatgaaagttttgagttcaagttttctctgagcagaggggacttggttgaaatgatctccaacaaaggacggattttcggctattacaatggtctggacagggcaaacgggtcaatcggcattcgcgagcatgatttagaaaagagcaagggaaaagacggcgtgcaccgtgtgggggtaaagactgctacagcctttaataaatatcatgtcgatcccctcggaaaggagatccacagatgttcttccgagcctcggccaaccctgaaaataaagagtaagaaatga

SEQ ID NO: 2667 - RNA, 3192 nt, synthetic construct
  misc_feature 1..3192: note = Cas9 variant
  source 1..3192: mol_type = other RNA
atggagaaggactacatcctgggcctcgatattgggataggaagcgtgggttatggccttatcgactacgataccaaatccattatcgacgccggggtcagactgttccccgaagctaacgcagataataacttgggaaggcgggccaagcgcggcgcgcgacgtttaaaaagaaggcggattcaccgcctggagagagttaagtctctactctcagaatataaaatcataagtggtctggctcctacaaataaccagccatacaatatcagggtgaaggggcttactgagcaactgacgaaggacgaattggccgtagcactcctgcatattgccaaacggcgcggaatccacaacgtggatgtcgctgcagacaaggaggagaccgccagcgattccctgtctacaaaagaccagattaataagaacgctaaatttctcgaatcgcgatatgtgtgcgagttacagaaggaaagactggagaatgagggccatgttaggggcgtggaaaaccggttccttactaaggatatcgtccgtgaggccaaaaagataattgacacccagatgcaatactatccggaaatcgatgagacatttaaagaaaagtacatttcattggtggagacccgcagagagtactatgaagggcccggaaaaggtagcccttacggctgggacgcggacgtaaagaaatggtatcagctgatgatggggcactgtacttacttcccagttgagtttaggagtgtgaagtatgcatacacagccgatctatataatgctctcaacgacctgaataaccttaccatcgcccgggatgacaatcccaagctggaataccatgagaaataccacatcattgaaaacgtcttcaagcagaaacgaaaccctacgttgaagcagatagcaaaagagatcggagtgaatgatattaacatctccggctatcgcgtgactaagtctggtaagccacaatttaccagcttcaaactctttcacgacctgaagaaagtcgttaaggatcatgctatattagacgatattgacctgctcaatcagatcgccgagatccttacaatttaccaggataaagactccatcgtggcggaactggggcagttggagtatctaatgtcagaagccgacaagcaaagtattagcgagctgactggatacaccggcacacactctctctccctgaagtgcatgaacatgataatcgatgaactttggcattcaagcatgaatcagatggaggtattcacctatctgaacatgagacccaaaaagtacgagttgaaaggctatcagaggattcctacggacatgatcgatgacgcaatcctcagtccagtggtcaagcggtcttttaaacaagctattggggtggttaatgccataatcaagaagtacggactgccgaaagatattatcattgaattagctcgcgagtccaacagcgccgaaaagtcgagatacctgagggcaatccagaaaaagaatgagaaaactcgtgagcggatagaagccatcattaaggagtatggtaacgaaaatgctaaaggcctagtgcagaagatcaagctccacgacgcgcaggaggggaaatgtctgtactctcttaaggatattcccttggaagacctgctccgaaaccctaataactatgatatcgaccacataattccaagatccgtctcattcgatgacagtatgcataataaagtgctggtaaggcgcgagcaaaacgcaaagaaaaacaatcagacaccctaccagtatcttaccagcggatacgccgatatcaagtattccgtttttaagcagcacgtgctgaacttggctgagaataaagaccggatgactaagaaaaagagagaatacctcctggaggaaaggaacattaataaatacgacgtccaaaaggagttcatcaaccgcaatttagtggatacacgatataccacgcgggaactgaccacactactcaagacttacttcaccataaacaatctggacgtcaaagtgaagacaatcaacggctcttttactgatttccttcgtaaaagatggggttttaagaaaaatagggacgaggggtataagcatcacgccgaggatgcattgattatcgccaacgctgactacctgttcaaggaacataaactcctgaaggagattaaagatgttagcgacttagccggcgatgaacgcaattcaaacgtgaaggacgaggatcagtatgaagaggtatttggaggctacttcaaaatcgaggacataaagaaatataagattaagaaatttagtcaccgggtcgataagaaacctaatagacagctgatcaacgacaccatctactccacaagggtgaaggacgataaacgataccttattaacaccttgaagaatctctatgacaagagcaacggggatctgaaagaacgcatgcagaaggacccagagtctctactgatgtaccaccatgatccccaaactttcgaaaaactcaagatcgttatgtcacagtatgagaatgagaaaaacccgctggcaaagtactttgaagagacgggacagtatcttacaaagtacgcgaaacacgacaatggtcctgctattcataagataaaatattacggcaacaagttggtggaacacctggatatcaccaaaaattaccacaacccccagaataaggtcgtgcaattaagtcaaaagagcttccggtttgacgtatatcagactgataaagggtacaagttcatttccatcgcctatctcaccctgaaaaacgagaagaattactatgcaatttctcaagaaaaatacgaccagcttaagtcggagaagaaaatcagcaacaatgccgtgtttataggatccttctatacatcagatatcattgagatcaacaatgaaaagttcagagttattggcgtcaacagtgacaaaaacaatctgatcgaggtggacaggatagatattcgtcagaaggaatttatcgagttggaagaggagaaacaggtgaactacatgaactctgacagctacctcaagaataatcgcatcaaagtcaccattggtcggaagactacaaacatagaaaagttccatacggatatcctggggaatatgtataaatccaagagaccaaaagctcctcagctagtttttaagaaaggctga

SEQ ID NO: 2668 - RNA, 3195 nt, synthetic construct
  misc_feature 1..3195: note = Cas9 variant
  source 1..3195: mol_type = other RNA
atgagcgagtgcgtgaccagaaggatcctgggcattgacctcgggatagcctcctgtggatggggtgtcatcgaagttggcgaggcttctgggtcaattatcgcaagtggagtgcggtgcttcgatgcgccccttattgacaagacaggcgaacctaaaagcgccactcgccgaacggctcgtggtcagagaaggatcatacggcgcagaaggcaacggatgaacgccgtacgccgactgttggcagagtttggggtgttaaccggaagatccccagatgccctgcaccaggctctactcaggctgtctcagtcggtcgcaggctcacaggtgacaccgtggactcttcgggccgctgcccatgaacgtaagctgaccaatgacgagttggcggttgtgctcggccacatcgcacgccatagagggttcaggagcaacagtaaaaatgatggaggtgccaacgctgccgacgagacatccaagatgaaaaaggcaatggaaaccactcgggagggcctggctcgataccactcttttggggccatgattgcgagcgatcccaagttcgccgaccgcaaaagaaatagggataaggactattcccatacagcaaaacggtcagatctggaagacgaggtccgcaccatctttagaagtcaaacgaggttcggaagcctcgtggcttctgagaagttatcccaggcctttgctgatgccgcattctttcagcgtcctctgcaggactcagaagacatggtaggcagctgtccattcgagcccggtcaaaaacggactgccagacgagctcctagttttgaacttttcaggtttttgtctcgcctggcgaacctaaagctcaccgttgggcgggcaccagagagaaggctgacacccgatgaaattgcccttgctgccaagggattcggcgagactaaaaagtccatcaccttcaaaagcctgcgcgaggcattggacctcgatcctaatgcccgattttcgggcgtggctaaggaaaaagagtctacactggacgtcgccgcacggaccgggggagcggcttacggtacgaagactttaaaagatgccctgggcgacgcaccatggcgttccctctcaagaatgccggaaaaacttgataggatagccgagattctgagtttccgcgaagacatgaaggctatccggaacgggttggaggaggtgggactagatggcctggtggtcgacgccctcatgcaggcaacagctaatggtgattttaaagacttcaccagagccgcgcacattagcgccctggctgcaaggaacatcatccccgggcttcgagaaggcctggtttattccgacgcctgcactcgcgtgggatacgatcacgctgcccggcctgcagtaccattgtctcagattggcagccccgtgacaagaaaggcgctctcagaggccctgaaacaggtcagggctgtggcccgtgaatatgggcctatagactactttcatatcgagttagcacgcagtattggaaagtccgctgaggaacggaaaaagctgaccgatggtatcgaggccagaaatgttgaaaaggagaaaaggcgaaaggaagcagccgagcacctaggccgggctccaagcgacgatgagctcctgcgctatgaacttgcgaaagagcaaaacttcaagtgtatatactctggggaccccattgatccggccggaatctcagcaaatgacacgagataccaggtggatcatatcttgccttggagtaggtttggcgacgatagctatgtcaacaaaaccctgtgcacagctcggtccaatcagaacaagcgaggtagaactcccttcgaatggtttgacgccgataagaccgaggccgaatggatggagtactctgctcgcgtggaggacctcaaagaagtaaaggggaggaaaaagcgtaactattcgattaaagacgcagccagcgttgaggataagttcaaggcgcggaatctgacagacactcaatgggctaccagacttctggccgatgaattgaaaaggatgtttccacctcgcgagtgtgaacgagtggtcacagtgagagcagacggcggaaacgatggcctctccatcgtcgaggagcggagggtgttcacccgccccggggccattacttcaaagctgcgtagagcttggggattagaaggtctgaaaaagcaggacggcaaacgggttgaggatgacaggcaccacgcagtggatgccctagtactcgcggctacgacagaaagtctgcttaatcgcttgaccgtcgaggtgcagcagcgagaaagagaggggcggcaagacgatatatttcattgctctcagccatggcccggattcagggttgacgtgcagcgcactgtctacggcagcgagaccatgcctggtatcttcgtgtccagagccgaaaggcggcgtgcacgcgggaaggcccacgatgctacagtaaaacagattcgagacatcgacggcgagagaatcgtgtttgaaaggaagccaattgagaagctgaccgataaagacctcgagcggataccggttcccgaaccttatggaaaggccgcagatccaaagaagctgcgcgacgagttagtcgaaaacctgagagcttggatcgccgcgggcaaacccaaggataagcctccaaggtcacccaaaggggacattatccggaaggtgcgaattgagactaaagataaggtggccgtcgaaatcaatggaggcacagttgacagaggtgatatggcacgcgtggacgtgttcaggaaaaagaacaagaaaggggtatgggagttttacgtcataccgatctatcctcatcaaattgtggctagcgcccttccacccaatcgggctgttatcgcatacaaggccgagtctgaatggacggccattgatggatgtttcgagtttgcttggtccttgaaccctatgagttacctcgaactggtgaaaagcaatggcgagctaatcgaaggttatttccgttctatggacagaaccactggcgcgataaacctgtcccccatgtcaacaaatagtgagaccattaggagcatcggggtcaagacactctcgtcctttcgcaaattcactgtggaccggctgggacgaaagtttgagattccaagagaagttaggacctggcgcggcgaggcatgcacgtga

SEQ ID NO: 2669 - RNA, 3195 nt, synthetic construct
  misc_feature 1..3195: note = Cas9 variant
  source 1..3195: mol_type = other RNA
atgaagagaaccagcctgagggcctaccggctcggcgtggaccttggggctaactccctgggatggttcgtcgtttggttggatgaccacggtcagcccgagggcttagggcctggaggcgtgcgcatctttccagatggtcgaaatccgcaatctaaacagtcaaacgcagccgggcgtagactggcgaggagtgctcggcgcagaagggaccggtatctacagcgccgaggaaagctcatgggcctgcttgtaaaacatggcctgatgcccgccgatgaacctgcaagaaagaggttggagtgcctcgacccatacgggctgcgggccaaagctctggatgaagtgctccccttacaccatgtcggacgtgcactgttccaccttaatcagcgcagaggtttgtttgccaacagggctattgagcaaggcgacaaggatgccagcgcgataaaggcagccgctgggcggctgcagacatccatgcaggcctgtggagcacgaactctaggcgagttcctcaatcgcagacatcagctgagggctacggtgcgggcccgctctcctgttggtggggacgtgcaagcgagatatgagttttacccaaccagggccatggtcgatgcagagttcgaagctatctgggccgctcaggcaccccaccaccctacaatgactgccgaggcccatgacaccattcgtgaagctatcttttcgcagcgggcgatgaaacgaccatcaattggaaagtgcagccttgatccggcaacaagtcaggacgacgtggatggcttcagatgtgcctggtcccaccccctggctcaaaggtttcgcatctggcaggacgtacggaacttggccgttgtggagaccggccctacttctagcagactcgggaaagaggatcaggacaaggtcgcaagggccctgttacaaacagatcagctgtccttcgacgaaatacgcggactccttggtctgccatcagatgctcgatttaatttggagagtgaccggcgtgatcatctaaaaggcgacgccaccggggcaatcctgagcgcgagaaggcacttcggacccgcttggcacgatcgctctctcgaccggcagattgacatcgtggccctgcttgaatccgcactggatgaggccgctattatcgcctcattgggcacgactcatagcctcgacgaagcagctgcccagagagcgctgagtgccttactgcctgatggttattgcaggctagggctccgagctataaagcgcgtgctgccacttatggaggcaggccggacctacgccgaggctgcctctgcagcgggatatgaccacgccttgctgcccggcgggaagctctccccgacaggatacctgccttactatggtcaatggcttcagaacgatgtcgttggcagcgacgatgaaagagacactaatgagaggcgttgggggcgcctgcccaacccaaccgtgcatattggaatcggccagttgcggagagtagtgaatgaactcattaggtggcacggtcctcccgctgagatcacagtcgaactgacccgagatttaaaactgtcgccacggcgcctagccgagctcgagagagaacaggcagagaaccaaaggaagaatgacaaacggacgtctctgcttcgaaagttggggctgcccgcttccactcataacctcctgaaattaagactgtgggatgaacagggcgacgtggcctcagagtgtccttacacaggagaagcaatcggccttgagcgcttggttagtgatgacgtggacattgatcacctcataccatttagcatctcctgggacgattctgccgctaataaggtcgtgtgcatgaggtatgcgaaccgtgagaaagggaaccggaccccgttcgaagccttcggacacagacagggtaggccctacgactgggcagatattgctgagcgcgccgcccgactgcctagaggcaagcggtggaggtttgggccaggagctcgcgcacagttcgaagaactaggcgactttcaagcccgtctgctcaatgagactagctggctggcgagagtagctaagcagtatcttgccgcagttacacatccccaccggatccatgtgttgcctggtaggctgaccgccttactccgcgctacgtgggaactgaacgatcttctgccagggtcagacgatcgagcagccaaaagtagaaaggaccaccggcaccatgcgatagatgctttggtcgccgcactcaccgaccaggccctgctaaggcgcatggctaatgcccacgatgacacaagaaggaaaattgaggtgctgctcccctggccgactttccggatcgacctggaaacccgtcttaaggcaatgttggtctcccataaacctgatcacggcctgcaggctcgcttacatgaggacacagcctacggaactgtggaacacccagagaccgaggatggcgcgaacctcgtttatcgaaagacatttgtggacatcagcgaaaaggagattgatagaatcagggaccggcgcctgagagatcttgtaagggcccacgtcgcaggggaacggcaacagggaaaaaccctgaaggctgccgtgctatctttcgctcagcgaagagacattgcaggccatcccaatggtatacgccacgttaggctcactaaatcaatcaagcctgattacctggtgcccattcgggacaaagccgggcgtatctacaagagttataacgccggagagaatgcttttgtcgatatcttgcaagcggaaagcggcagatggattgcaagggccacgacagtgttccaggctaaccaggccaatgagtcccatgacgcaccagccgctcagcctataatgcgcgtatttaagggtgacatgctgcggatcgatcacgcgggcgccgagaaattcgtgaagattgttcgattatctccctcgaacaatctcctgtaccttgtcgaacatcaccaagcaggggtgtttcagaccagacacgacgatccagaggacagcttcaggtggctgtttgcttccttcgataaattgcgcgaatggaacgccgagctcgtgcggatcgacactctgggacagccgtggagacgtaagaggggcctagaaaccgggtcagaggatgcaacacggattggatggacccgccctaaaaagtggccctga

SEQ ID NO: 2670 - RNA, 3198 nt, synthetic construct
  misc_feature 1..3198: note = Cas9 variant
  source 1..3198: mol_type = other RNA
atgaacaaggacatcaattacgccctgggcctcgatattgggataaccagcgtgggatgggctgtcatcaaccttgacctgaatagaattgaggatttgggtgttaggatcttcaacgcagccgaaaatttaaaagacggctcctctctggcgctaccccggcgcctcgctcgagggcgtagaaggctgcttcggcgcaaggcctatagagtggagagggtacggaaactgattttgaagaacaatatcctcacaaaagaagaactggaaggactgtttaagaacaaggaggtgatagatgtctgggaggcacgcgtgaaaggcctcgactacaagttatcacgagaagagtgggccaaaatcctgattaatttctgcaagagaaggggttttaaaagtaaccggaagaatgaagctaaggataaagaggcagggcagatccttagctccatttcttataacatcgagaagatgaaagaaactaattcgcgtacgataggagagtacatttataacgaagttaaaaattcagaggacagctacgcccctttgcgcaacaaattcggcgaatataagatgtgtgtgagtagagatgtcatcagggaggagattcacaccctgtttgaaaaacaacgggagctaggcaacaatttcgcttccgacgaaatcgaggataagtactttgaaatcttcaactctcagcgaccatttagcaatttcgaggacctcgagaagctggtggggttttgcacattcgaacgcaaaaagcataaaagagccccgaagcactgtatttcctcagaggaatttactctttacgagggaataaacaaactgagtatcattaaggatggtgaaaagaggaaattgagcgaggaggaacggaccctcgtagttaatgaggcgttcaacaagaaagaaatcaagtatacaaccctgcgcaaattactgggcctctctgaggaggaacttttctccactctgacatactcaatagacaaggacattagcaagaccgagaatacgaaatttgtgagtttgaaggggtatcatgaaatcaaaagagcaatcgagaagggagtctctaaaaaggcctggcaggatattgaaaacaataggaacctactgaatgacatcgcttacgtgctcactctgggcaagaccgatgacgagattgagaaacagcttcgtctgcggaacgtgcccgaagagttgttcgaatccctcctggatatgagctttaataagttcaacaatttatcgatatatgccctggagaaaatcctaccttttatgaaggaaggttaccaatataacgaggcatgcgagaaagctgggtacaacttcaaggccatttacgaaggagtccgaacaaagaagctcccagttatcgagatcgacgaaattgtgaatcccgtagtgaacagagcgctggcccagactaggaaggtcataaattctgtgatcgataaatatggctcccctgttcgcattaacatcgagcttgcacgggacttggctaagaattttaaagatagaaagctgattgaaaaagagcagaaggagaacagggccaatctcgacaagatccgcgaaaacctgcgagagcttatggataaagaaccaaccgtggtcgaggtgctgaagtaccggttgtgggagcagcaacgtggcgaatgtgcttatacacagtcacagatacccctcgagagactgttcagtcctgggtactgcgaaatcgaccacattatcccatttagcaggtccttcgacgattctttaagcaataaaattctggtactaggatcagagaaccagcgcaagggtaatcggaccccgtatgaatactttggcgaggacagtgagagatggaactccttcgaaatctgggttaaagggagctatctcaattacaagaagaaagccaacctgcttaagaaaaagttttctgaggaagaacaaagggattggaaagcacgaaatttgcaggacacgaagtacatatgtcgctatatttcaaacttcgtgaacaatcggctggagttcaaggagagtgagaacaaacagaaggtcatcactgtgaatggcagagccacagcttacctcaggagccgttggggactgaacaaagtccgcgaagatggtgacaagcatcacgcgttagatgcagccgtggttggggtgaccactcaaggcatggtacagaaaatttccaagtattctaaagctcacgagctgtacacagtccggaagaatgacgaatttgtggatgttgagaccggagaatgcgtggacgtcgatgagtataaggagatcagaaaagacatacttcccaggccttggcgaggcttctcggaagagttgaagctccggctgagcgataacccactagaggagctgaaaaagtcccccatcgagacgtacaatgaagagtttattaaagaaaacgtgaagcctatcttcgtatcacgcgtgccatttagaaagattagtgggaaactcttcaaggagaccatctattctgaaagggcctttaaagacggatacttcgttagcaagaaatccctggtcgaccttaagcggggtgatttggacaatttttacaactatgagtgtgataagaaactgtacgacgcaatatcagagcgaatgaaggagttcaattataacggcaaaaaggcctttgaaagccccttcagaaaaccgacaaagtctgggaaggaaggacctgtggtgcgctccgtcaaaattaagagtgctgttccctttaaagatggcatcccaatgaatgagggtttagtggccaaggaagggatggtgaggatcgacatttacgagaaagagggcaagtatttcgtagtccctgtgtaccgttatcagctcgcaaagggaatcgttcccaaacgggcggctattgccaagaaagatgaactgaagtggccaataatggaccagacttacaacttcaaatttagcatctacaagaatgatcttattgaggtgaaatatgacaagaagggcgtctacttcgggtattacgatggatttgacagaaactctgcatccctgaccatcgaaaaacatgataactcagagaggtatcgcagtattggtttgaaggtgggcgttctcgaaatcaataaatacgaggtggacgtactggggaactatcacaaggtcaaactaggaggcaattga

SEQ ID NO: 2671 - RNA, 3198 nt, synthetic construct
  misc_feature 1..3198: note = Cas9 variant
  source 1..3198: mol_type = other RNA
atgaacaaggacatcaattacgccctgggcctcgatattgggataaccagcgtgggatgggctgtcatcaaccttgacctgaatagaattgaggatttgggtgttaggatcttcaacgcagccgaaaatcccaaagacggctcctctttagcgctgcctcggcgcctagctcgagggcgtagaaggctcctgcggcgcaaggcctatagagtggagagggtacggaaacttattgtgaagaacaatatcctgacaaaagaagagttggaaggactctttaagaacaaggaggtcatagatgtgtgggaggcacgcgttaaaggcctggactacaagctgtcacgagaagagtgggccaaaatcctcattaatttctgcaagagaaggggttttaaaagtaaccggaagaatgaaactaaggataaagaggctgggcagatcttaagctccatttcttataacatcgagaagatgaaagaaacgaatagccgtaccataggagagtacatttataacgaagtgaaaaattcagacgatagctacgcaccactgcgcaacaaattcggcgagtataagatgtgtgtcagtagagacgtgcttagggaagagatccacacattgtttgagaaacaacgggaactgggcaacaatttcgcctccgatgagattgaagacaagtactttgagatcttcaactctcagcgaccgtttagcaatttcgaagatctagagaagctcgtagggttttgcactttcgagcgcaaaaagcataaaagagctcccaagcactgtatctcctcagaagagtttaccctgtacgaaggaattaacaaacttagtataatcaaggacggtgagaagaggaaactgagcgaagaggagcggacattggttgtgaatgaagccttcaacaagaaagagattaagtataccactctccgcaaactgttaggcctgtctgaagacgaactcttctccacacttacctactcaatcgataaggacataagcaagacggagaatactaaatttgtcagtctgaaggggtatcatgaaattaaaagagcgatcgagaagggagtgtctaaaaaggcatggcaggatatcgaaaacaataggaacttgctaaatgacattgcctacgtgctgaccctcggcaagacagatgacgagatcgaaaaacagctgcgtcttcggaacgtccctgaggagctgttcgaatccttgctcgatatgagcttttcgaagttcaataacctgtctatttatgctttagagaaaatactgccatttatgaaggaaggttaccaatataatgaggcctgcgaaaaagcagggtacaacttcaaggctatctacgagggagttcgaactaaaaagctacccgtgattgagatcgacgaaatcgtaaaccctgtggtcaatagagccctcgcgcagaccaggaaggtgattaactccgttatagataaatatggctcaccagtgcgcatcaatattgagctggcccgggaccttgcaaagaactttaaagatagaaagttgatcgaaaaagagcagaaggaaaatagggctaacctggacaagattcgcgagaatctccgagagctgatggacaaagaacccacagccgtcgaggtgcttaagtaccggctgtgggaacagcaacgtggcgagtgtgcttatacccagagtcagatcgccttggagagactcttcagccctgggtactgcgaaatagatcacatcattccattttccaggtctttcgacgatagcctgtcaaacaaaatcttagtactgggaagtgagaatcagcgcaagggtaacaaaattccgtatgaatactttggcgaggactccgaacggtggaatagcttcgagatctgggttaaggggtcttatctaaactacaagaaaaaggcaaatctcctgaaaaagaaatttacggaggaagaacaaagagattggaaggccaggaaccttcaggacactaagtacatatgtcgatatatttcaaatttcgtgaacaaccgcttggagttcaaagagagtgaaaataagcagaaagtcatcacagtgaacggacgggctaccgcgtacctgagatcgaggtggggcctcaataaggtccgtgaggatggtgacaaacatcacgcactggatgccgctgtggttggggtgactacacaaggcatggtacagaagatttccaaatattctaaggcccacgagttatacaccgtccgcaagaacgacgaatttgtggatgttgagacgggagaatgcgtggacgtcgatgagtataaagaaatccggaaggacatactgcccagaccttggaggggcttctcggaggagcttaaattgcgactcagcgacaatccactggaggagctaaagaaactgcccatcgaaacctacaacgaggagtttattaaggaaaatgtgaagcctatcttcgtatcccgggtgccatttcgcaaaatttcagggaaactcttcaaggagacaatctatagtgaaagagcatttaaggatggatacttcgtttctaaaaagagcctggtcgaccttaagaggggtgatttggacaacttttacaattatgagtgtgataaaaagctgtacgacgccatatccgaacggatgaaagagttcaactataatggcaagaaggcttttgagtcacccttccgaaagccgactaagagcgggaaagaaggacctgtggtgagatctgtcaagattaaatccgccgcaccctttaaggatggcatcccaatgaacgagggtttagttgcgaaagaagggatggtgcgcatcgacatttacgagaaggaaggcaagtatttcgtggtacctgtctacaggtatcagctcgctaaaggaatcgtgcccaagcgtgccgcaattgccggcaaaagtgagctgaagtggccaataatggatcagacctacaatttcaaatttagcatcttcaagaacgaccttattgagatcaaatacgctaagaaggatgggtattttggatactatgacggtttcgatcggcatacagcctctctggttattgaaaatcacgacaactccgacagatacaggggcatcggggtgaaaactggagtcgtggagtttaacaagtatgaagttgatgtgttgggcaattaccataaagtaaacctcggtgggaattga

SEQ ID NO: 2672 - RNA, 3201 nt, synthetic construct
  misc_feature 1..3201: note = Cas9 variant
  source 1..3201: mol_type = other RNA
atgagcgagagagtggtcaggcggatcctgggcattgacctcgggatagcctcctgcggatggggtgttgtggatatctctggcgctgggggaggcattatcgcaaccggtgtacgctgtttcgacgcccccttgattgataagacaggggaacctaaatcagcgactcgacgtacggctagaggacagaggcggatcgtgcgcagaaggcggcaacgcatgaacggcgtccgaagactgttgtgcgagtttggcttactgccagacccgaggcccgatgccctaaatcaggcaatgcggcgtataagtaccgccagcgctgcagcccaggtgacaccttggactctccgcgctgccgcgcaccagagactgctttccaacgaggaactggcagttgtgttggggcatatcgccaggcaccggggattccgatctaatgctaagaacgaagccggtgcaaatgctgccgacgagacctcgaaaatgaagaaagcgatggaggccacacgcgaaggcctcgcaaagtaccatgcttttggggatatgattgccaacgacccaaagttcgctaatagaaaaaggaaccgggataaggactattcacacaccgccaaacgcagcgatctggaggacgaagtcagagcaatcctgagggcccaactccgttttggaagtgctgcggcaactgagacattagcccagaccttcgctgatgtggcctttttccagcggcccctgcaggactccgaggaccgagtaggcgattgtccttttgaaccaggtcaaaagagagcagccaggcgcgctccctctttcgagctttttcggttcttgagcagactggccaatctaaaactcgcagttgggaggtcccctgaacgccgactgacggcggaggaaattgctcttgccgcaaagggatttggcgagactaagaaaaccatcacattcaagtcactgcgggaggccttggacctcgatccaaacgctcgtttcagtggcatagggaaagacaaggaagccagcctggatgtggtcgcaagaactggaggtgctgcctacggcaccaaaacattaaaggacgcgctgggggatgccccgtggaggtctctctcccgcacccccgagacgcttgaccggattgctgaaatcctgtcatttagagaggatattactagcatcaggaatggattggaagacctaggcctggatagtctcgtggtggaggcactgatgcaggccgctgccaacggtgacttcaaagagtttacacgagcagggcatatctctgcgcgcgccgctcggaatattatacctggccttagagaaggactggtctattccgaggcctgcgcaagggttggctacgaccacgctgcccgtttgagcgtgccactcgatcaggtagggtcgcccgtgacccgcaaggcactgtctgaagccttaaagcaggtccgggctgtggcgagagagtatggacctatcgactacttccacattgaactggccaggtccgttggtaaatcagcagaggagcgaaagcaactaactgatggcatcgaagctcggaacgtggagaaagccaagcgcagaaaacaggccgaggaacatctcgggagggctccaagtgacgatgagctgcttcggtatgaattggcaaaggagcagaattttaagtgtatatacagcggagacgccattgatcccgcgggcgtcgctgccaacgacacacgataccaagtggatcacatcctgccgtggtccagattcggtgacgattcttatctcaacaaaaccctgtgcacggcacgcagcaatcagaacaagagggggcgtaccccttttgaatggttcgaggccgacaaaacagatgtagaatggatggagtacgttgctcgggtggagaatcttcaggaagtcaagggcaggaaaaagaggaactattcaatcaaggacgcagccgcgattgaggacaaatttaaggctcgcaatctgactgatacccagtgggccacacgattgctcgcagacgaactgagtagaatgtttcccccacgggagtgtgaaagggccatctgcggacgcgctgatggcgggaacgacggattaactattgtggaggagcgtagagtcttcacccggcctggtgccataacatccaaactgaggcgcgcatggggcctagaagggctcaagaaacaagatggaaagcgagtggaggacgatagacatcacgctgttgacgccctggtgcttgcggccaccactgaaagccttctgcagcggctcacggtagaggtccagaggcgcgaaagagagggcaggcccgatgacatcttccactgtgcagagccatggcggggttttcgtgctgatgtgcgccgaacagtttacgggtctgaaaccatgcccggcattttcgtgtcaagagccgagaggcggcgcgctagaggaaaggcacatgacgccactatcaaacagatcagggaaattgagggcgagcggctggtcttcgaacgaaagcctgtggagaaattaaccgataaggacctggagaaaataccaatcccgaagccctatgggcaagtaagtgaccctaaaagacttcgcgatgaattggtggaaagcctcagggcctggattgctgcgggaaagccaaaggaccggccccctctgtccccaaaaggcgatgttatccgtaaggtcaggattcagacaaatgacaaagtgtctgtggagatcaacggtgggaccgtcgatagaggagacatggcacgcgttgatgtgtttcggaagaaaaataagaaggccgtgtgggagtactatgtagtccccatatacccgcaccagatcgtggctctaaacgaccctccagatcgagccgttattgcatacgccgaagacaaagattggaaggagatcgactcgagctatgagttcctgtggtccctctttggcctgtcatacgtggaaattagtaaagctaatggtgaatgcatcgacggctatttcagagggcttcataggggaactggcgcggcctctgtctgtaagcacattagcttggggaaagatgcaacagtgtccggaataggcctgaagacgttagcttcatttaagaaattcaccatcgaccgcctcggtcggaagtttgagattcccagagaggttcgtacttggagaggggaagcctgcacatga

SEQ ID NO: 2673 - RNA, 3201 nt, synthetic construct
  misc_feature 1..3201: note = Cas9 variant
  source 1..3201: mol_type = other RNA
atgagccacctggtgctcggccttgacctggggcccaactccatcggatgggccttggtcaatgatgaccctgagcatccagttgaatctaagttagtggatctgggtgtaagagtgttcccggagggcgtcgacaactttgatacctcaaaagaactaagtaggaatgaggaccggcgcgtggctcgagggatgcgtagacagattaggcggcgcgcaagaaggcggcaacagctcaagcaggccctgatagatagcaaactttggccctccgaccctaacgatgaagttgtgctgtacaatacaaacccatatgagttgcgcgcgcgagctctcaaggagagactggaaccccacgaggtcggaagggtgctgctccatttaaatcagcggcgtggcttcctgtctaaccgcaaaaaggacagaggtgataaggaagtacaagggatgcttgccgagatcaatgagaacgaacagcagtgcaaagacggaggctttgatactattggcgcatggttggccgacaagcaggctaatatcgaccacgcaaacagggaggaaaatgatcatgttcggaaccgacacctggcccgctcgcaatacgtggacgagttcgaagctatttggtcagtccaggccaaacaccatcctaagctactcacggaggagctgaaagtggggaaacttggaaagcagacctatccagtgaagcccatccctagatggcacgaacataggcagggtctgagcccattggagagttttggcatatacgggctcatcttctttcaacggccgatgtattggcccaagtccgtcgttggactgtgtgaattagagcctaaagaacgcagatgccagaggtctgatcgtcggcagcaacgattcagactgctccaggaggtgaataaccttaagtacgtagacccagatacacacctggagcagaaattggacgataagcagaggcgcctactgctcgacaaactgagccacactaaggaaatgacctttgatcaaattcggaaggcgcttgacttcctggagtccgtgaaatttaacttggaaagaggcgagaggtcacgcctcaagggtgtccccatcgatgcactgttcgccgctaaagacgtgttagggcaggaatggtatgaccgacctgagcagcagaagacagagattgttgccgtgctgctagataatgaacgggacgatgaccgtatcatagcaagagctgtcgccgagtggggaatgaccgcgaaagaagccgaggcaatgctcggcgtggatctgccagctggctacgccaaccttagttgtaaggctattgagaagttgctgccccatatggaaagggggctcctgtacatggacgatgacgagagcaattctgccatgcacgcagccggatatcttcgccgggatcaactgagaaggcgaatctttgacgtattgccggatcctgctcgcactcccaactgcccaattggtgacatccctaatcccgttgtgaaacggacactcaccgaaatcagaaaggtcgtgaacgcgattgtcagggagtacggcaaaccagatgcaatacatctggaattagcccgttccgtgcagatggggaaggagaaacgctcagagtatagcaagatgatccgggacagagaagctgagagggacggaattgttgaaaagctgcgagagagtggcgtgcgggtaacgcgcgataatatcctaaaataccagctctgggaacagcaaaaccaggagtgtatatattctggtaagcccatttccttcgagaaactgttcggggaaggcggaggcgtcgaggtggaccacatccttcctagaagcaggtcgttggatgactctcaggccaataagatcgtttgcctgcggactgcaaacgccgggaaaggagatcagaccccatacgaatggctcgctgacacacaaccgaagcagtatgaacaggtgtgtcaacgagccggtatgctgatgagatccggccgcatgccctacgcaaagtacaggcgttttattcagcgggagttagagctggataaattcatcgcgagacagcttgctgacactgggtatattaccaaggccacaatggagtacttgaggtatctctttgataaagaccatgatgtcctgggactaaagggccagctgaccgcagaactccgctaccactggggtctggagacgatacttgaagagttgcctgactcaccagcctggcacgaggctgatagtgggaaactgcgacccggcgaaaagaatagagccgaccatcggcaccatgcaatcgacgctgtggtaattgccttaactaacaggcgccgtctcgtgcaactgagcgatatcgttaaaagaggaggcgcgcgggcccacggggagatccttgaagacccttggccaaatttcagggagaacgtcgtgcaggctattaagaagacaaatgtgtcccaccgcgtcgaacgaaaagttgcaggaaagctgcatgaggagaccttgtatggtcccactagaacaccgggcgaatgggtgctccggaaacctgtgatagccctgtctgctaacgaggtagaaaggatccgcgatgccaccattagacagatcgtcgtgagcgcactagcggacgccgggattgatgttggaaggggcaagaaaccagacgctaagaagatgaaagaggccctgtcaaagctcaaaatgcccagtggtgtgcctatccggaaggtccgtctgacgaaacccgaacagaccatacaaccagtgcgcgcagggcgacctgatcaggcttttgttaagcccggctccacacaccatctttgcatcttcgagtttactgagaacggaaagaccaaaagagacgccgtgttcgtaacaatgttggaagcaatgaataggctgaagcggcgcgagccagtcattcagagaactcacccggaaaggcctgatagccggtttgtgatgtctttatcagcccgagagatgctcctggctaactggaaagacggcgaaagacttctgaccttcaagacagcgagtagcacccaggggcaaatctggtttgccgagcatactgatgcacgcaaatccgctgactacaagcagttcgtggccaatgccaacacgctagacgctaagaaagtcacagttgatcccctcggaaggattcggtgggcaaatgactga

SEQ ID NO: 2674 - RNA, 3204 nt, synthetic construct
  misc_feature 1..3204: note = Cas9 variant
  source 1..3204: mol_type = other RNA
atgggcactagactggggctcgacatcggaacaaacagcattggttggtgccttttcaatctggatggctccgggaggcccataggaatccgggacattggcgtgcgcatcttttctgatggtcgagaccctcgttcaggggccagtttggctgtcgagagaagggttgcacgggccatgcgcagaaggcgggatcgctacattcgaagaaggagcgcgttactggaagctctaatcaacactggactcatgccagccgacgtgcaggagtccaaggcactgacgggctgtgatccgtatgtacttcgggcccaagctctggaccgtgcattggatgcccacctcctgggccgcgtgctgttccatctcaatcagagaagggggtttaaatctaaccggaaggctgaacgaaaagccggagacgataaggagggtggcaaaatagcggacggggcaaaggccttagatctggctatgcacgaagccggagcacgcacctacggcgagttccttgctggtagagactcgaggcgggtccgcttgagagccgagggggacggatatgatttttaccccgaaaggcgtcatctggaggcggaatttgacgccatctgggatgcacaggctgcctataatcctgctctactcacagacgtggttcgggatcgactgagaaggattatctttttccagcgcccacttaaggcccccaaagtgggcggctgcactttcttcaacgaggagcctcggctgccaaaggcacaccccttgtttcaagaaagaaggctctacgaggaagtcaatcagctggagattacccgcgccggggctccttcacgaaaattaacactggaccagcgggataagatcatacgtaaactcaagagcgcgaagaccgcaagtttctccggacttgccagactgttgaaactagctgacggtgaatcttttagcagggtgactgagaaccgcacaggcctggccggggatgacattttcacctccttctcagataagcggtgttttggagacagatgggcacatttcgacccaggcgtacagtggagtatcattgagacggttactgaagaggaagatccggtgaggctccgagactggctgatggccacccacggtgtcacagtggagcaagctgaagccatcgggcgcgtgcggcttcccgagggccacggaagactgggcgagactgcaagcaggttgatcctcgcgcagctgaaatctgggtccaaggatggacatcctttaacctataatgaagctgtcgaggccgcactgggtaaatcacacagcgactttcgtacaggcgaaattctagagcagctcccatactacggggaaatactgagtcgcgagattccccctggatctcttgatccagacgatgacgatgagatccggtggggcaagatcaccaaccccacggttcatataggtttgaatcagctgagaaggctcctgaacgcccttattaaagctcacgggcgaccggacgaaatcgtggtagagctggcccgggaattgaagctctccgagaaggataaagcagagcacaatcgcagaatcggcgctaacactagggccgcggaagcccggagcaagaaactgttagagtcgggacaacctgacacaggcgctaatcgatctctgctaaagctctgggaagatctgaaccccaacaatccacttgacagatgctgtcctttctgcgggcgccatattggacagatggcattgttttccggtgagaccgaaatcgagcacattataccctattcaaggagtctggacgatagcgccgctaacaaagtgatcgcccatcgttcctgtaatcgggagaagggcaacagaactccatgggaagcatgggggcacacagagaggtgggcgattatcgccgaacaggtctctcgcctccataagagcaaacaatggcgattcgctcccgacgccatcgagagatttaatcaggaaggaggcttcattgcacggcagctgtcagatacccagtacttaagtaggatggctcgcacgtatctgtccagcctttaccctgacaccgccggtgtgtatgttataccagggcgtatgacagcaatgttgagacggctctggggcctgaacgagctactgccggatcacaattacgtggagaacccccactctggagcccctaagaataggctcgaccatcgccaccatgctatcgatgcggccgtcgtgggcgtaactacccgagggctgcttaacgaaatttcaagagcagctggacgggccgagaggcaagacttggatcgcctgtttatcgacttaccaaaaccctgggaaacattcagagaggatctccacgaaagtctggccagggttgtgggcagccacaaggctgaccatggtcggaaaggggtccctgcaaagggaaaggatgccactgcggctcgtcttcacaatgagaccgcctatggcctgacaggtttgacctccgagtctggcctcccaattgtggtccatcgcgtgcccctgctatcgctgaaaccggacgacctcagcaaccctatccgaataccagatgcagccctgcagagagctcttagggaagcaactgacgggaagtccggaaaagattttcaggaggccttggcgcagttctcaaagagtgaccccgtttttaaaggcatccggcacgtgcgcgtaagagaaacgctgaaggtcattcctatcagggatgcttctgggcatgccttcaaggcatacaaaggagacgccaatgctcggtacgatgtgtggcgaatgcccgacggcaagtgggttagctcctggagagatcgcgacggtaaagcccactcagggattatcacaatgttcgcagctcaccaagccggacagccagtgcagaggcctcatcccgcggccaagcgggtcttaagcctccgtcagaacgatctggtggcagtagagccacaaggccagccgagaaaaataatgagggtggttaagttttcttccggtggccagattaccttcgctgagcaccaggaagccgggcctcttaaagctcgcgacgcaaccagtcccgacatcgatccatttaagtatttctacagctctgccggaggcctgcaaaaggcccgggctcgacagattagaatcgacgagctagggaggatatttgatcccggacctcgctga

SEQ ID NO: 2675 - RNA, 3207 nt, synthetic construct
  misc_feature 1..3207: note = Cas9 variant
  source 1..3207: mol_type = other RNA
atgaagtacgtgctgggcctcgacatcgggattgccagctgcggatgggctgtcataaaccaggagaaacacagaatcgaagatcttggtgttaggattttcgacaaggcagagaatcccaaagatggcaagtccctggccacccctcggcgcgacgcgcgatctacacgtagaactttgaggcggaaaaagcatcgcatgcaaagaatcaagattttactggtgaaacacgggctactctcaaagacggaaatcgatcatctgtatgagagtgctaccgaaatagacgtatggtaccttaggctgaacgccttggagcggcgcctcaatccaaaagagtttgcacgagtgctgatccacctgagcaagagaaggggattcaaatccaaccggaaggaaacaactctctctgagaatggccagattttagaaaacatctcggagaatctgcagattatggagcagaagaactatcgtaccgtcggtgaaatgatccttaaagataagcgctttgagaatcataaaagaaacaaggacgggacatacataggaaccgtgactaggcaacagttgcaggaagagattcagatgatcttcaatgcccaacggctgtataaaaacaatcacgctacagaaaagtttgagtcaagctacctagagatttgggcaagtcagcgaccgtatgcctccaaagatcagatcgaaaagatgatcggctactgtaccctcgagcccaaggaaaaacgcgttcctaaggcttcttggagcttccagtactttgtggccctgcaaacgattaacaatcttagactgatatccaaagacaggatcgaggaattgtcattcgaggagaagaaacggattatgaacctcgcgctggaaaagagtatcgtcaagtatatagatattcgcaaattactgagcgtgccaaaggagtttcagttcaactctctctcctactcagcagacatcgtagatactaccgttgaaaataaaaagtgcatcgagcttaaagaatatcacagcattaacaaggtgtacaagcagatctatggccaaaatgccctgaacttgctacccaaagactacgacacaattgcttatgggctgactatatttaaggatgacaaagatatccaggagtacctccagaataagtacgtcaacgccaaaggaaagcctattagtaatctggcaaacaagacctatgacgatacattcatccaggtgcttctgaccttgaatttttctaaaatgggtcatctctccttcaaggctctgaaaaacatcattccattcttagaggaaggcctgagctacgacaaggcctgtgagaaagcggggtataattttaagggaacgtcgtacactaaaaagacaaagtatctacccgtgatacctcaaaacaccaatccagtcgttcacagagccctctctcagactaggaaagtgatcaacgcaattatcaagaaatacggctccccgaatgctattcatatcgaaacagcccgtgagctgtcaaagaccttccaggagcggaaagaaatagatagtatgtatcaggacaacagcaagaagaacgagcacgctatctgcaaacttaaggaattgggtaatattaacccctccgggatcaatattgtaaaatttaagctgtggaacgagcaagatggacgatgtatgtacacgggcaaatacatcgaacctcacagactcttcgaggagggctataccgaagtggaccatatactgccatactctaggagccttgatgactcatataataacaaggtcctgacattggggactgagaatcagcgcaagggaaacaaaaccccctacgaatatatgcggaataacagtatttgggacgagtttgaaacaagagtgcagtccaataagaaaatcaacaagaaaaagcagcaaaagctcctgttacagaatttcagccacgccagggagcaggagtttattgaacgcaacctgaatgatactcgatacgcaaccatctatctatcttcactcatacagcaacatctgatcttcagtgagagctcccgggagaaaaaggttcacacagtgtctggtattatcacctcgcatcttcgtagcagatggggctttaacaaagacaggaaggaagggcacattcaccatgccttggatgctgtcatcgtggcggtaacttccgaccacatgatacagcgcgttacgaaatactacaagctgaaagaactcaaccggaatagacaggcaaagaggatgcaattccctgagccatgggagggatttcgactggaattagaggcccgcatttcacccaacacacagcagtatctgaagggcatccggttcaaaaattacgctgatgtgaaccttagtgaaatcaagccgatttttgtctctagaatgcctaaaaggagcatcaccggtgagttgcatcaggagactattcgtaagttcctcgggtataatgaaaaaggcaaggtgctgaccgccacaaagaccaaactagaggacatacccttcgatgcaaacggagactttccaatgttcggcaaggaaactgatctgtacacatataatgccatcaaagagcgctacctctcccacaagaaagacaagtcaaagagctttcaagaacctctgtataaacccacgaagtctgggggaattggtccacttatcaaatccattaagatcatggatacccggactatagtcaaccccgtgaatcagggcaaaggggttgtgtacaacagtaagatcgctagaacagacgtattcaagaaaggagagaagtactatttgattcctatctacaccattgatctgatgaaaaatacattaccacagaaggccatcactgcaggcaaaggttatgaggactggaccacgatagacccgagctttaccttcctcttttctctgttccccaacgatcttattcagatcgtcccttccaagaataagacaatcaaagcgaggactaccgtgtcaaagaaagaagttctgttgccaagtctcacagggtactttaagggcgtgcacagcggaactgctggcattaccgtcgagacgcatgacgggtcgataatcgccaacgtgggatccaaacaactgctatctttcgaaaagtatcaggtagatgtgctgggtcactacacaaaaattaagaaggagaaacgaatcggcatggcaatttga

SEQ ID NO: 2676 - RNA, 3207 nt, synthetic construct
  misc_feature 1..3207: note = Cas9 variant
  source 1..3207: mol_type = other RNA
atgaacaaggccgtggcttacagactggcactcgaccttggcagcacctccctggggtgggccatcttcaggttgaatgaggcgcgggaacccacagctattatacgcgccggagtccgaatcttttctgatggtcgtaacgcaaattcagagcctttagccgttcacagaagggtggctcgggcaatgcgcagaaggcgggaccgcctgctaaaacgaaagaaaagaatgcatgatcagctcgtacaacacggcttctttccagccgaagtggctgagaggaaggaactggagcggcttaacccgtatcagctgcgtgccaaagggttgcatgaggcgctcactcccggagagttcgcacgcgccctgtttcacattaatcagagaaggggcttcaagagtaaccggaagacggaccgaaaagataatgacagcggtgctctgaagcaggccatctccgaactccgcaaaaggattcaagattctgactgcgcaaccgctggggaatggttttggaaggagagaatgcagcagaaacctgagggagtccggggccagtgggtgcgcgccagatacaggaagacaccatcgactaccgatgaaggcaagaaacgtatcgggtatgacttatacgttgatcgggcgatggtggagcaagagttcgacgccctgtgggcagctcaggccgcccttcagcccggattgtttacagaagctgcacgagccgaactgaaggataccctactctatcagagagacctgaggcctgtcaaaccaggtcgctgtactcttctgcccgctgaggagcgggcgcctttggcactcccatcaacacaaagattcaggatactgcaggaagtgaacaatttacgcctgctcgacgaggcccttcgagaagtaccgctgaacttggctcagcgggatgccgttgtgagcgcactagagggcaagaaagaactgagttttgccgctatccgtaagctcctgaccctttccgggaaattcaatctggaggacgagaagagagccgaattgaagggaaacgcaacgtctgtcattctcgcgaggaaagatctgtttggcgacgcttgggccggtttcgatgcagccgtgcaagacgagatcgtgtggcgcttagtcagccaggaatccgagggggctctgattgcctggctacagcagcatactggagttgatggcgtgtgcgcagaagctatcgtaaatacccggctccccgacggctacgggagactgtcaaggaaggcccttgagcgaatagtgcctgcgttgcaacgcgaggtctgtacatatgataaagccgtgcaggctgcaggattcgcccaccacagtgacctgggttttgatttcgactacgctgaagacgaggttcaacaggtgggcgaacatactattgccagcaccggggaggtccaggcacagtacgcgtttaagcagctcccatattacggaaaagccctgcagcggcacgtggctttcggctctggtgatgccaaggaccatgaggaaaagtgctatgggaaaatcgcaaaccccacagtacacattggccttaatcaagttagaaccgtggtcaacgctctgatcaggcgttacggacaccctacggaggtggtcgtggaattggcccgcgatctcaagcagtcccgggagcagaaacagcaaactcagagagaacaggcagacaaccaaaagaggaatgaggatatccgaaaacggattgccccaatactggagacatcacccgaacgcgttagagacagggatatcaagaagtggattttatgggaggaactgaacaaaaaggacatcgctgatcggcattgtccgtatagcggcgagcgaataagtgcgaccatgctactctctgaagccgtggagattgagcacatcctgcctttttccagaactcttgacgatagcttgaataaccgcacagtagcaatgaggcgtgctaatcggatcaaaggggacagaaccccctgggaagccagggccgatttcgaggctcagggatggcgctacgaagcaattctgcagcgagccgagggtatgccacctagaaagcggtataggtttgcggaagacggctaccagcgctggctcgggaaagaccgtaacttcctggctagagccttaaatgatacgtcgtacctgtctcggcttgcagccaactatttgaggctcgtctgcccccaaggagtgcgcgttatcccaggccagatgaccgacaagctgcgaggtaagtttgggctaaattccgtgctgggcctcgatggcaaaaagaacagaaatgaccatcggcaccatgctgtcgatgcatgtgtgattggagtaacagaccaggggctgatgcagaggttcgccaacgcgtcaaaacaagctcgcgagaatggacttactagattggtgcaggatatgctgttaccctggtggcctagttactatgaccacgttgagagggccgtccggcacatacgtgtgagccatcgcccagatcacggttttgaaggcgcaatgatgaaggggaccgcccatggaatccgagaggacggcattagagaagatggtaggatcaaacagcggccgaaggctaaagggtccgccgaccacaagacaatcactctcattcccatagatgagcctcgccagctggcaagacacggcgtggacgctgagggaaagccacttccctacaaaggctatgcctctgggagcaactactgcatcgaaattaccaagaatggaaaaggcaagtgggagggtcaagtcatctcaacattcgacgcgtataggattaaagccgcagctgatgccgctgcacgggccgggcaggttatcagtaccgtggaagccgactccatagtgcgaaagagcggatgggagagactgcgcggcgctcagtctcaaaacggtcagcctttggtaatgaggctcgtcatcggcgattcagtgcggatggaagttgacgggcgtgatgaggtgatgagagtcgtgaagatgagtggaaaagagatggtttttgcgccagtgagggaagcaaacgtagacaagcgcaataacatgcccgatgagcaggacccgttcacttacacgtacaaacgggccgatcagctgcgaaaggctaaagccagacaagtcacaattagccctatcggcgaactaagggacccagggttcaagggatga

SEQ ID NO: 2677 - RNA, 3207 nt, synthetic construct
  misc_feature 1..3207: note = Cas9 variant
  source 1..3207: mol_type = other RNA
atgcagtacgtgctgggcctcgacatcgggattgccagctgcggatgggctgtcataaaccaagagaaggaaagaatcgaggatcttggtgttaggattttcgacaaagcagaaaatcccaaggatggcaaatccctggccgcgcctcggcgcgacgctcgatctacccgtagaacattgaggcggaagaaacaccgcatgttaagaatcaagattctgctagtgaagcaggggctcctgtcaaagaacgagcttaatcatctgtatgaaagtactacggaggtagatgtgtggaacttgaggctcgacgccctggagcggaagctgaatccaaaagaatttacccgcgtcctcatccacttagcaaagcgaagaggattcaaaagcaacaggaaggagacaactctgtccgaaaatggccagatacttgagtctatctcggagaaccagcaaattatggaacagcagaattaccggaccgtgggtgagatgatcttgaaggataaaaagtttgaaaaccataaacgtaataaggacgggacatatattggaaccgttactcgccagcaactgcaggaggaaatccagatgatattcacagcccagagactatacaaaaacgattatgctaccgaggagtttgaaatttcatacctcgagatctgggcaagccaaaggccgtatgccagtaaggaccagattgagaaaatgatcggctactgtacgctggaacccaaggaaaagcgggtgcctaaagcatcctggtctttccagtactttgtcgcccttcaaactatcaataacctgcgattgattagcaaggatcgcatagaggagctctccttcaaagaaaagaaacagatcatgaatctggcgttagagaagtcaattgtgaagtatatcgacataagaaaactgctcagtattccaaacgaatttcagttcaacagcctttcttactccgcagataccgtagacacaactctggagaataagaggtgcatcgaattgaaagagtattactcaatcaacaaggtttataaacagatttacgagaagaatgccctaaacctgctccccatcgactatgataccattgcttacggcctgacaatatttaaggacgataaagacatccttgaatacctgcaaaataagtatgtgaacgccaaagggaagcctattaataacttggctaaaaagacctacgattatacgttcatccaggctctcctgactttaaattttacaaagatgggacacctgagcttcaaagccctaaagaacatcattccattcctcgaggaaggtctgagttacgacaaagcgtgtgagaaggccggctataattttaaagggacctcttacactgagaagacaaaatatcttcccgtcatacctcagaacaccaatccagtggtgcatcgggcattgtcccagacgcgcaaggtcatcaacgctattatcaagaaatacggaagcccgaatgccattcacatcgaaaccgctagagagctgtcgaagacattccaagaaaggaaagagatagattctatgtaccaggacaactccaagaaaaacgaacacgccatccataagctcaaggagctgggcaatattaacccctcaggtatcaatattgttaaatttaaactttggaacgagcaggatgggcgttgcatgtatagtggaaaatacatcgaacctcaccggctgttcgaggaaggctatactgaggtggaccatatattgccatacagccgatccctcgatgactcttataataacaagaccctgacattaggcactgaaaatcagagaaaagggaacaagaccccctacgagtatatgggaaatacaagcatttggaacgactttgagaccagggtacactcaaataagaaaatcaacaagaaaaagcaacagaaactgctactccagcacttcagttacgcacgcgaacaggagtttattgaacggaatctgaacgatactagatacgccacgatctatctttccagcttgatacaacagcatctgatcttctctgagtcaagtaggaagaagaaagtgcacacagtcagcggtattatcacctcccatctccgctctcgatggggctttaataaggaccggaaagaagggcacattcatcacgctctggatgcggtgatcgttgcagtgacttcggaccacatgatacagcgtgtcaccaagtactataaattaaaggagctgaacagaaaccttcaagccaaaaggatgcctttcccagagccctgggaaggatttcgcttggagctcgaagctcggattagcccgaatacacagcagtacctgaagggcttcagatttaagaactatgccgatgtgaatctatccgagatcaaacctatcttcgtatcaaggatgcccaagcgaagtattaccggtgagctgcatcaggaaactatccgcaaattcattgggtacaacgagaagggcaaagttctcacagcaataaagacgaagctggaagacatcccatttgatgccaatggagacttccctatgtatggcaaagagaccgatctttacacttacaacgctattaaggaacggtttttgtctcacaaaaaggacaaaagaaagagcttccaagagcccctgtataagccaacaaaatccgggggaatcggtcccttaattaagtcaatcaaaataatcgataccaggacaattgtgaatcctgtcaaccagggcaagggggtggtctacaatagcaaaatcgcccgtactgacgtgtttaagaaggatgagaaatattacctcattccaatctataccatagacctgatgaagaacattcttccgcagaaagcaatcacggcgggaaagggctacgaagactggaccacaatcgatccctctttcacttttctgttctccttgtttcctaatgacctcattcagatagttccaagtaaaaacaagaccatcaaggctcgcacaactgtgagcaaaaaggaggtactgctaccctctctgaccggttatttcaaaggggtccattccggcacggccggaattacagtggaaacccacgatggctcagttatcgcaaatgtggggagtaagcaactcctgcttattgagaaataccaggtcgacatcttgggacactacactaagataaaagaagagaagcggatcggtatggccatttga

SEQ ID NO: 2678 - RNA, 3207 nt, synthetic construct
  misc_feature 1..3207: note = Cas9 variant
  source 1..3207: mol_type = other RNA
atgcccaagagcgccaaacctcagcaggcttacaccctgggcctcgacatcgggattgcatccgtgggagccgcgcttctgggtcaacagcacataatcggcttgcatgtcagaacattcgatagggctgagactgccaaggaaggggagccattaaacaaaattcggcgcgacgcacgactgacgcgtagaaggctacagcggcgcgcccacagactcctgaggcttcggcgcctgtttaagcgacataatttgatcccggataccgacacatctactttcatttcaggacaaagtccctgggaactcagagctcagggcctggataggcagctgaccagcgcagagtggacaaccgttctctatcacatcgtgaaacatcggggttttcactccaaccgtaagtctgaagtaaagactgacgagaaagccgggcagatgttatcgggagtgaatcaaaaccaggctctgcttaagcagtcaggcttgcgcacaatgggcgagctggccgcgagacacgaagcattcagggaggccaaacggaataagaaaggggcttacaaccatacctttagccgacacgatctagaagacgagctccatctgcttttcagtcgccagagagagctgggaaatccttatgccacgccagaattggaggatgcagtccacactctcctgatgcaaaggcggcccgctttatccggtaccaacctgctcaagatggtgggccactgcacacttgaacctgacgagtttcgcgccccaaaggcgtcttacactgccgaaagattcatatggctgaccaaattgaataacctaagggttagcgggtccggagagacacgtcccctgaatgagtcagaacggcaggcactcctgagtaagccttttagccagtctaaacttacctataagcaagtgcgaaaaatcctggagttgccagataacattagattcgtcggcctccattaccacccggctcaggacaatggtaagtcccccgaaaacagggtgtttttcgaggccaaggcttttcatgccctgcgcaatgtatataaaaaggcagggttaaacctggaatggcagcgggattcacagaaccctgagaaactagacaatatcacgtacgccctcactgttttcaaggaggacaaagaagctaagcaatggctgattgagaaaggagtggaagcgagcgtcatcgaggcagtgcttaacgaaagtttctctgagtttgtgagattgtccataaaggccctgaggaagattatcccacacatggagattggccatcgctacgatgaagctgtcaaactcgccggctatagccaccactcgcatctgccccagccttctaagacaccatacatcccccgattctccaaacagtcaatcgcaaatccggttgtgagtcgggcccttaaccaggctcgtaagctggtaaatgccattgtgagagagtatgggcctcccgacgcagtccacatagaattggcgagggatctcaacaaaccatttgacgagcgccggaagatcgagaaggatcaagaaaaataccagaaggacaaagctagagatattgagaccttccaggaaaattttggattcactcctaagggtctgcagttaacaaaatggaggctgtatcgagagcaaagcggcaagtgtgcctactccctaaagcccctcgacatcaaccgcctgtttgaagatgggtatgtggagatagaccatgcacttccatactctcggagcttcaatgatggaatgaacaataaagttttgaccctgacgaccgagaacagaaataagggcaaccagacaccctacgaatatctcgacggtgcctcaaatagtgctcagtggaggaactttgtggcctgggtcaactccaataaaagctaccgtgcatctaagcagcgcaacctgttacggaaagacttcgctgcccaagcggccactgagtttagagaaaggcacctgaccgatacacgatatattgctcgggagttcaagcgcatggtggaaactcaccttaaattgaataagcctaaccagagatgcgtagttgtgtcagggcagctcaccgcatacctgagggcccggtggggcctaatcaaggtccgagagaatggagacctgcatcacgctctcgatgccgcagtggtcgcggcctgtagtcatgctatggtgaaaagactggccgactatagccgcaggggcgagcttcaatacgcacgtgggcaccattttgatccagaaacaggagagatcattgacatcaacgctttgcggaagctggatgaccacttcccgcagccctggaccgatttcagaagggaattactcgcctggctgtcccctgacccagcacagcagcttaaaaatctggcctattacactgatgagcgcttgaagcaagttaaacccattcgagtgtctagagctcctacgcggaggggtctcggcgcggcccaccaggaaacaatacgctcggcaaagtacctgggggagaaccgtagcaccgtaaagactccactagagaaactgaagctcaaagacatccccaatattgtcggatatgaagatccgagaaaccatcagctgatccaggctatctcccaacggcttaccgagcacggcgacgacggtaagaaagcctttaaggaacctttgtacaagccagggaataacaaatcaacagcccccgtggttaggagtgtgaagctgttcaccgtccagaaatctggcattcctgtgcgcggaggcatagctaataacgggaatatggtacgagtggatatctttactaagaaagagagatatttcgcagttcccgtctacgtgagcgacgccgcgcggaacgagttaccaaacaaggctgtggccaggggaaaggatggttggattgacatcgatgactccttttcattcctctttagcctgtatcctaatgattgggtctctgttgtggtgaaaccccatgaagcaccatgcgagggctactatgccgggcttgacatttccacaggagctatccacatatgggcacatgatcgcaacagaagtgtaggcaagaatggtctgatgaggagcatcgggattaaaacggcccactctgtcgaaaagtaccacgtggacctactcggcaacctgtaccgggttgtgcatgagacccgtaaaccgttgcgcgcgggaaagtga

SEQ ID NO: 2679 - RNA, 3207 nt, synthetic construct
  misc_feature 1..3207: note = Cas9 variant
  source 1..3207: mol_type = other RNA
atgcagtacgtgctgggcctcgacatcgggattgccagctgcggatgggctgtcataaaccaagagaaggaaagaatcgaggatcttggtgttaggattttcgacaaagcagaaaatcccaaggatggcaaatccatggccacccctcggcgcgacgcgcgatctacacgtagaactctgaggcggaagaaacaccgcatgcagagaatcaagattatcttggtgaagcaggggttactgtcaaaaacggagctagatcatctctatgaaagtgctaccgaggtagacgtgtggaacctgaggcttgatgccctggagcggaagttgaatccaaaagaatttacacgcgtcctcatacacctggcaaagcgaagaggattcaaaagcaacaggaaggagactaccctgtccgaaaatggccagatcctcgagtctatttcggagaaccaacagatcatgggtcagaagaattaccggacagtgggggaaatgattttacaggacaaaaagtttgagtcacataaacgtaacaaggatggaacctatatcggcactgttacacgccaacagctgcaggacgaaatacagatgattttcaatgcccaaagactttacaaaaacaattatgctaccgcagagtttgaaaacagctacttggagatctgggccagtcagaggccgtatgcttccaaggatcagattgagaaaatgatcggctactgtacgctggaacaaaaggagaagcgggcccccaaagcgtcttggagcttccagtactttgtggcactacagactatcaataacctccgactgatttccaaggaccgcatagaagaactttcattcgaagagaaaaagcagatcatgaatctggccttggagaaaagtattgtcaagtatatcgatataagaaagctcctgagcgtgcctaacgaatttcaattcaactctttatcctactcagctgacaccgtagacattacagttgagagcaggaaatgcatcgaactgaaggagtatcacagtatcaataaagtgtacaagcagatttatgagaaaaacgccctcaatcttctgccaaaggattacgacactatcgcatatgggttgaccatttttaaggatgacaaagatatactagagtacctgcagaacaagtacgtcaatgctaaaggaaagcccatctctaacttcgccaataaaacatatgacgatacctttattcaggcgctcctgaaccttaatttcacgaagatgggtcatctgtccttcaaggccttgaaaaacatcatcccttttctcgaggaaggcctgagctacgacaaggcatgtgagaaagctgggtataatttcaagggaacttcgtacacagagaaaaccaagtatttaccagtgattccccaaaacactaatcctgtggtccaccgggccctgtctcagacacgcaaagttataaacgctatcattaagaagtacggctccccaaatgccatccacattgaaaccgcaagagagctatcaaaaacgtttcaggaaaggaaggagatcgatagtatgtatcaggacaacagcaaaaagaacgaacatgccatatgcaaactcaaggagctgggtaatatcaacccgtccgggattaatatcgtgaagttcaaactttggaacgaacaagatggacgttgtatgtactctggcaagtacattgagccccaccggttgtttgaggaaggctataccgaggtagaccatatcctgccttacagccgatcactcgacgatagttataataacaaaacactgactcttgggaccgaaaatcagagaaagggaaacaaaacaccatacgagtatatgggtaatacttccatatggaacgacttcgaaaccagggtgcagagcaataagaagattaccaaaaagaaacagcaaaagctgttgctccagcacttttcttacgctcgcgagcaggagttcatcgaacggaacctgaatgatacaagatatgcgactatttacttatcaagtctgatccaacagcacctaatatttagcgagtcctctaggaaaaagaaggtccatacggtgtcgggcatcattacaagccacctccgctcccgatgggggttcaacaaagaccggaaggaaggacatatccaccatgcactggatgccgttattgtggctgtcacctcagaccacatgatccagcgtgtgactaaatactataaacttaaagagttgaatagaaacctgcaggccaagaggatgccctttcctgaaccatgggagggcttccgcctcgagctggaagcacggataagtcccaacacccaacagtacttaaaaggttttagattcaagaattatgccgatgtaaacctgtctgagattaagccgatcttcgttagcaggatgcctaaacgatccatcacaggggaacttcaccaggagaccattcgcaagtttatcggctacaatgagaaaggaaaggtgttgactgctattaaaacaaagctcgaagacatacccttcgatgccaacggcgactttccaatgtatgggaaggagacggatctgtacacctataatgcaatcaaagaacggttcctatcacataagaaagacaagagaaagagctttcaggagcctctgtacaagcccactaagtctggaggtattggcccactcatcaaatccattaagatcatagatacaaggaccatcgtcaaccccgtgaatcaagggaaaggagtcgtgtacaacagtaagattgcgcgtacagacgttttcaaaaaggacgaaaagtattacctgatccctatttatactatcgatcttatgaaaaatatattgccacagaaggctattaccgccggcaaaggttacgaggactggacgaccatcgatccgagctttacattcctgttttctttattccccaacgacctcatccagattgtgccttccaagaataaaactataaaggcacgcaccacagtatcaaagaaagaggtcctgcttccaagtctgactgggtattttaagggcgtgcacagcggaaccgccggcatcacggttgaaacacatgatgggtcggtgattgctaacgtcggatccaaacagttgctcctgttcgagaagtaccaagtggacgtactaggtcactataccaaaatcaaggaagagaaacggattggcatggccatctga

SEQ ID NO: 2680 - RNA, 3210 nt, synthetic construct
  misc_feature 1..3210: note = Cas9 variant
  source 1..3210: mol_type = other RNA
atgaagaaacagccccaaagatacatcctgggcctcgaccttgggattgccagcgtgggatgggctctgatattggtcgatggtgcagagaaccctgttggcttactggactgcggggtgaggaccttcgaacgggccgaggtaccaaagacaggagattccctagcgctcgctcgccgacaggcccgttctgtgagaaggctgatccggcgcagagcacacaggcttctgcggttgcgccgactcctgaaaagagaaggcattctgtcagccgctgactttaatagtgatggtctcccgaacttacccatcgacgcatggcagctgagggtcgccgggcttgagcggaagttgactaatcaggaatgggctgccgtgctgctacatctcgttaaacaccgtggatatctgagccaacgcaagtccgagacgcagaccgagaacaaggaacttggcagactgttggcgggcgtggcagaaaattctaaactcctgtcggagtcaagcgagcagtacaggactcctgccgagttagctgtcaagctgttcgccgaacagagtgggcggctccgaaacaaaggaggtgattatacacatacctttaatcgccttgacctgcaaaaggagttgcacctactgttcgaaagacagtgtgcactcggcaacccatttgcttccgccgagctgcagtctaaagtggatgaacttctgatgacacagaggagcgcgttgcaaggggaggccgtactcaagatgctgggaaagtgcaccttcgagccctccgaatacaaagcagctaagaatacttattcagccgagcggtttatttggttaacaaaactgaacaatctacgcatcctctacaacggcgaagacagagctctggatgagggtgaaaggaagcagcttttggacgagccttataaaaaggccaaactgacctacaagcaggttcgtagtatactcaatctgccagagagcgcagtgttcaaggggcttcggtacggaaaagattctgacggcctgaaggccgaaaacggcgctttgatggagatgaaagcgtatcataagatccgaacggtcctcgaaaaagcagggctgaagggagagtgggaaaatagaattaggaaccccgagatcttagaccaaattggtactgccttttccgtgtacaagaccgatgaggacatcaaagctgaactggccgcactacgcctccctgagaacgtgctggatgcccttttggctggcctgaatttcgacaagtttatacagctctcactgaaagccttaagcaacattctgccacttatggaacgggggatcagatatgatgaggcatgtaaggaggtctacggagaccacagggcgttggctgaaagtaaaaatcagatgctcctgccgcagattcccgccaacgagatccgcaatcctgttgtgctacgaacactgactcaagcacggaaggtaatcaacgccattatacgtagatatggctctccacagagggtgcacatcgaaaccgctcgcgagctcggtaagtccttcaaagatcggaaggaaattgagaaaagacaggaggaaaataggaaggagcgagaacgcgccgcagagcattttaaagaactgttcccccggttcacaggggagcctaagagcggcgacatccttaagttgagactgtaccagcaacagcagggaaaatgcttatattcgggcataccaattgatctcgggaggctgaacgagaagggatacgtcgaaatcgaccacgcccttcccttttctcgtacctgggatgactccttcaataacaaagtgctggttttgggttcagagaatcagaagaaacgcaaccaaacgccgtacgaatatctcgacggcgctcgggatagtcagagatggagggagtttcaggcgcgagtgcaggggtgtcggttcccttacgccaagaaacaacgcatccagactgctaagctggacagcaagacagaacagggatttctagagagaaatctgaacgataccaggtatattgcacggttcctctgcggctttatcgagaaatccctgcatcttcaaggtgccgggaagcgaagagtcttcgcttctaatggccagattactgccttgctgcgcggattatggggcctcaaaaaggtgagggaagacaacgatcgtcaccacgcactggacgcgatagtagttgcctgtagcacagtgtcaatgcagcagaaaatcaccaaggctatgcaacggagagagacgcttgaaaccattaacacagagactggggaggtcaagaccaggatcccccagccatgggactttttccgccaggaagtgatgatccgagtctttagtgatgcccctagagaggaactggcagagaaactaaattcccggcccgaagctctccatgatttcgtgagcccactgtttgtttctagggcccccaaccgcaagatgacaggacagggtcacttggagactgtgaaatcagcaaagcgtctgagtgagaatattagcgtagtcaaaaagcctttaaccgccctcaagctgaaagacatagaaaacatcgtgggctacccagatagagagccggctctttatcgggcgctgcaagaaaggttgcaggcctacaaggacgatcccgcaaaggctttcgccgagcctttctataaaccagccaaagacgggggacagggctccctcgttaaggctgtgcgcattatcgaaaatacaaagcatggtctgaaagtccgaaacgggattaccgacactaatggcgatatggtgagagcagacgtataccagaaggccgataaaaagggaaaacggcaatactttatcgtgcccgtttatgcgtggcaggtcgagaagaacgagctacctacggtggactgcaaaggctacgaaatagatgacacatatgagttctgtttttctctgtacaagtatgatatcattgaaatccagaatccagacaacatgtcgaaggagcttagggtgtactatattaattgcgatagctccgacgggcgcttctggctcgctcaccatgataaatcagccaaggaacaacagtttagaatcagtacccagaaccagcccataattaaaaagtaccaagtcgacccgctgggaaaagagatcaggttgtgtaaggcagagaagcggactgaactgaatggcaaaaagaaaaagtga

SEQ ID NO: 2681 - RNA, 3210 nt, synthetic construct
  misc_feature 1..3210: note = Cas9 variant
  source 1..3210: mol_type = other RNA
atgaactacgacatcggcctgagaattgggataaccagctgcggatggtccatcattaataaggatctcgagaggatcgaagaccttggtgtgcgggtcttcgagaaagccgaaaaccccgatggcacagcttctgcagcccctcgccgagaggcgcgtaagtcaagaaggaaacaccggcgcaagaaacatagaattgaaaggatcaagcggctgatagttcagcacgacttgttaagtaagaaagagctggatagcctatatctctccccatttaatatcgacgtgtggaacctgcgcgtagaggctcttgaacgaaagctggataatagagagttcgccagggtgttgattcatctcgtccaacggcgtgggtttcagactatccgcaaatctgtggaaattcaggaggagggaaagctgctggaaaacgtttcggagaatgaaagaatcatgaaagtgaacggctacaagacggtcggtgagatgttctcaaagcacgaaaaatttacccatcacaagaggaataaagacgggagctatacaagtgtggtaactcggtccctcttactgaaggagataaaaaccattttcaactctcagcgaatccttggaaatgtttttagcacacaaaagttggagtccgattacctgtatatttggggctcacagcgcccgaccctaacttacgaacagctcatgagtatggtgggcaactgtatctatgagaaaaaggaaaagagagcacccaaaacaagctgggccttccagtacttttctctgcttcaaaagatcaataaactgaaggtctccgacgataacaccttgaggaaactctcaaaggaggaacgggacattgtgatagagctggctttcaagaaaaagaatgtgagctttgtcgatatccgcaaagcattaaagctgaacgacaacacgaaattcaatcacctcacttacagtcatgttgtggagaccaagaaggtagaaaaagccacatttattgagcttaaggggtatcacctgatcaaaaagcagttgaaagacagaaacgtggaactaactcaggagctgcagcctaaggattacgacgctatagccgcggcatctaccttcttcaagaatgatattgaatttagggactatctccgtaaccaatacctggattccaatggaaaacgaaagagcaacatcgccaataaagtcttcgaggacaaggtgatcgctgccgtttttgagcttaacttctcgaaagtgtgccatctgtcttttaagtccttgtataaactcattccacacctggaaaagggtttagattacaaggaggcaatcctgtgtgctggctataatttccgggacgaaaacaaaagagataagaaactatttctccccgtcattcagcaggagacaaatcctgtggtacacagggccctgacccaagcgcgcaaggttataaacgccatcattcgggagtacgggtcaccaaatacgatcagattcgtggtcgcaaacgaccttgctaaaacttacaagcagaggaaggaattggagagtacactgaaaaagaatcgcgccgaaaacgagaaaatcaagaccaaactcctgagcatgggaattataaaccccactggcatggatatcgtgaagtataaactttggtacgaacagtccggtatttgcctgtatacagggcgacagatggagttgtctagcctctttaagcctggatactcaatcgtcaatcatattatcccatataaccggagtttcgacgacacctaccacaatcgtgtgctgacgttaaccgagacaaagtatgaaaaaggcaacaagataccgtttgagtacttcggcgctgaagagacttgttggaatgaatacgagaaaagagtttccaccagcaagaagatccatgataaaaagagggagaaactgctaattcgcaactttgacatcgaatatgagaatgaaatgatttctaacaatgtgttcgatacacactacatcgggtcatatttcgagaagtacatagacgaacatctccaatttaaaaagagtactaaaaagcagaaggtattcagcattcacggaaacatggtcgcccaccttcattcccggtggggttttaataaaaactctagagagatctatcttaatcacgcagtggatgccgctattgttgcggtgttgaccgaccagctgatcaggaacatagcagattactatcgacgcgacaatatcctcgagcagaagggctcgctgaaattccccgaaccttggaagtccttttccattgagttagaagcccggatctcaccacaagtcagagatctgattaaaaagctgaacttggacagttacctcgatgtggacatcctgcatataaagcccgtattcatttctaaaaagcctaggcgtaaagtgaacggggaggctcacaagagcacaatccgctccctaatcggaattaatgagatcggcaaaaccgttacttgcattaagacgcggctggaagatataccatttgacgagaacggtgacttccccatgtacgggaaggatacagacaaatatacctacactgccatcaaggaaagatatctcgagtttaataaagataaggaaaaagcattctcaaccccgctgtacaaacttaagaggaacggcgagcctggaaatcagattaagagcgtcaagatcattgacacacgaaacatcgtgaataaagtgaaccagggcaaggggatagcctataattctaacatcattcgggtcgatgtttttagccgcgaccagaaatactatgtggtgcccatctacttgagagatttcattaagggaagtctgccaaataagatcataaccgctgccaaaggttttatgcaatggcctgagactgacaacagctacacattcttattctctatttttcccaatgatctcatcaaggtagtcccaaaagaaggcaagttcatcaaagcaaagaacgagaataaagaaaacattaacctgacggagatacttgggtattttaagggactggactcctcaaccggcgcgttcactttggaaagtcacgatggtagcctcctggctagggggatcggcacaaagaatctactgctcattgagaaataccaggtggacgttctgggacggtataacaaggtgggcaatgaggaacgacaggatatcaaaattcagcaaaactga

SEQ ID NO: 2682 - RNA, 3210 nt, synthetic construct
  misc_feature 1..3210: note = Cas9 variant
  source 1..3210: mol_type = other RNA
atgaactacgacatcggcctgagaattgggataaccagctgcggatggtccatcattaataaggatctcgagaggatcgaagaccttggtgtgcgggtcttcgagaaagccgaaaaccccgatggcacagcttctgcagcccctcgccgagaggcgcgtaagtcaagaaggaaacaccggcgcaagaaacatagaattgaaaggatcaagcggctgatagttcagcacgacttgttaagtaagaaagagctggatagcctatatctctccccatttaatatcgacgtgtggaacctgcaagtagaggctcttgaacgcaagctggataatcgagagttcgccagagtgttgattcatctcgtccagaggcgggggtttcagactatccgtaaatctgtggaaattcaggaggagggaaagctgctggaaaacgtttcggagaatgaacgcatcatgaaagtgaacggctacaagacggtcggtgagatgttctcaaagcacgaaaaatttacccatcacaagagaaataaagacgggagctatacaagtgtggtaactaggtccctcttactgaaggagataaaaaccattttcaactctcaacggatccttggaaatgtttttagcacacagaagttggagtccgattacctgtatatttggggctcacagcgaccgaccctaacttacgaacagctcatgagtatggtgggcaactgtatctatgagaaaaaggaaaagcgcgcacccaaaacaagctgggccttccaatacttttctctgcttcagaagatcaataaactgaaggtctccgacgataacaccttgagaaaactctcaaaggaggaaagggacattgtgatagagctggctttcaagaaaaagaatgtgagctttgtcgatatccggaaagcattaaagctgaacgacaacacgaaattcaatcacctcacttacagtcatgttgtggagaccaagaaggtagaaaaagccacatttattgagcttaaggggtatcacctgatcaaaaagcagttgaaagaccgcaacgtggaactaactcaggagctgcaacctaaggattacgacgctatagccgcggcatctaccttcttcaagaatgatattgaatttagagactatctcaggaaccagtacctggattccaatggaaaacgtaagagcaacatcgccaataaagtcttcgaggacaaggtgatcgctgccgtttttgagcttaacttctcgaaagtgtgccatctgtcttttaagtccttgtataaactcattccacacctggaaaagggtttagattacaaggaggcaatcctgtgtgctggctataatttccgggacgaaaacaaacgagataagaaactatttctccccgtcattcagcaagagacaaatcctgtggtacacagagccctgacccaggcgaggaaggttataaacgccatcattcgcgagtacgggtcaccaaatacgatccggttcgtggtcgcaaacgaccttgctaaaacttacaagcagagaaaggaattggagagtacactgaaaaagaatagggccgaaaacgagaaaatcaagaccaaactcctgagcatgggaattataaaccccactggcatggatatcgtgaagtataaactttggtacgaacagtccggtatttgcctgtatacagggcgccaaatggagttgtctagcctctttaagcctggatactcaatcgtcaatcatattatcccatataaccgaagtttcgacgacacctaccacaatcgggtgctgacgttaaccgagacaaagtatgaaaaaggcaacaagataccgtttgagtacttcggcgctgaagagacttgttggaatgaatacgagaaacgtgtttccaccagcaagaagatccatgataaaaagagagagaaactgctaattaggaactttgacatcgaatatgagaatgaaatgatttctaacaatgtgttcgatacacactacatcgggtcatatttcgagaagtacatagacgaacatctccagtttaaaaagagtactaaaaagcagaaggtattcagcattcacggaaacatggtcgcccaccttcattcccgctggggttttaataaaaactctcgggagatctatcttaatcacgcagtggatgccgctattgttgcggtgttgaccgaccagctgatcagaaacatagcagattactataggcgagacaatatcctcgagcaaaagggctcgctgaaattccccgaaccttggaagtccttttccattgagttagaagcccgcatctcaccacaggtccgggatctgattaaaaagctgaacttggacagttacctcgatgtggacatcctgcatataaagcccgtattcatttctaaaaagcctagaaggaaagtgaacggggaggctcacaagagcacaatccgttccctaatcggaattaatgagatcggcaaaaccgttacttgcattaagacgcgcctggaagatataccatttgacgagaacggtgacttccccatgtacgggaaggatacagacaaatatacctacactgccatcaaggaacggtatctcgagtttaataaagataaggaaaaagcattctcaaccccgctgtacaaacttaagagaaacggcgagcctggaaatcagattaagagcgtcaagatcattgacacaaggaacatcgtgaataaagtgaaccagggcaaggggatagcctataattctaacatcattcgagtcgatgtttttagccgggaccaaaaatactatgtggtgcccatctacttgcgcgatttcattaagggaagtctgccaaataagatcataaccgctgccaaaggttttatgcagtggcctgagactgacaacagctacacattcttattctctatttttcccaatgatctcatcaaggtagtcccaaaagaaggcaagttcatcaaagcaaagaacgagaataaagaaaacattaacctgacggagatacttgggtattttaagggactggactcctcaaccggcgcgttcactttggaaagtcacgatggtagcctcctggctagagggatcggcacaaagaatctactgctcattgagaaataccaggtggacgttctgggaaggtataacaaggtgggcaatgaggaacggcaggatatcaaaattcaacagaactga

SEQ ID NO: 2683 - RNA, 3213 nt, synthetic construct
  misc_feature 1..3213: note = Cas9 variant
  source 1..3213: mol_type = other RNA
atggccaccagactgggcctcgacatcgggacaaacagcattggatggtgcctttacgatggtgactccataagggatatcggcgtgcggattttcctggacgggcgcgagccctctaagttgactgtctcaggaagtggcacgcctttagctgttaaacgacgtgatgcaagaggtgccaggcggcgcagagacaggtatatcgggcggcgcagcgcgatgctgcgagaactaagaaagcacggactcctgccagctgatccgaaacaggccaaggtgcttgagacccaagacccctacgcactgagggtacgggccttggatgaaaaactcgagcctcatcagattggccgtgctctgtttcacctgaatcagcgcagaggcttcaagtccaacaggaaggcagaacgggcctctaaagctggggaggacggaaagatcgccacagcgactaaactcttagatgaggaaatgcagcgactgggtgcacgcacccttggcgagtttttggtgaagagagactcggagttcgatggggaggccggaaaaagggtccggatgcgcgctgactcaaaggcctatgacttttacccagatagaaggcatgtgctggacgagttccgtgcaatatggaatgctcaaaaggtttggcaccccgaactactcacagagcaggcctggaacgatatctttcgggtgattgaatatcagcgagagctgaaacctcaggtcgtgggccattgtaccttcgcgggtatcaatggggtaccagccgacgaaaagagacttcccaaagcacaccctctgtttcaacagaggcgcttgtacgaggaggttaaccagctcaaggtggtcgctccaggagaagccggccggccgctgactagagatgagagggacgctttaattctgaaactccaggataagaaaagcgtgagtttcgaaacacttggcaagaccctgaagttgaaagacggggagcgctttaataaggaatccgagaaccgaaaagccctagatggagacgaggtgcgggcagccctgtctggtaagaaactcttcggcacgcgttggtttcacttcagcgctgaagaacaatggatgatcatagaaagactgcttgaggaagaggattccgagactctgttgacctggctcaagattgggtataggctggacgacgaagcggcattagccgtcgctaatgccaagctgcccgagggacatggccgcttcggtctatcagcaacaactgccctcctgaaagaacttaaggctgatgtttgcacctacgccgaggcagcgaaacgggctgggtttcaccatagtgacttcagaacaggcgaggtgtttgatcagttgccttactatggagaaatcctggccagggagattgcaccaggcaagcccgaatacggggacgagaacgaacgacgcttcggaaaaatcaccaatcctacggtacacatcggtctcaaccagctgactaagctggtgaatgccattatacggctgcacggcaagccagattatatctttgtcgagttggctagagagctcaaactgaacgaaaaggagaaaattgcctacaataggcaattaaaggaaaacacagacgcagctcgtgatcgcggggccaaactgggaaccatgggcgtgcgggacactggtagaaacaggctaatcctccgactgtggacagagcttaatcccggggatgcgttgaaccggcgctgtccgttctgcggcgaacagataagccagagaatgattcagaatggagaggttgagatcgaacatatcattccttattctcaatgttttgacgatggcatcgggaacaaggtgctgtcccacgtcaggtgcaatcggcagaagggagaccagaccccctgggagcgatggggtcatgatccagacagatggtcaattatacaggaacaagtggcccacctccatcgcagcaaacagtggaggttcggccctgacgctcgtgatcggtacgcagccgaggaagacagttttctgcccagacagttaatcgatacgcagtatctgaccaggattgctgccaagtaccttgcatgtttgtacccagagcgcggggagcgacacgtattcgcggttcacggaggcatgacagccatgctcagacggctgtgggacctaaactctatcctgctcgatcataattgggtggaaaaccttaattccaacgctcccaaaaataggcttgaccaccgccatcacgccatcgatgcagctgtcgtgggtattatgactcctgggttgatagccgagatcgcaaaggccgctgcgcgtgccgaaaaacaaaacctggacagattatttgaggagctcccaatgccgtgggcacagcaccccaatgatcggaggttccgcgacgaactgcgagagaagattcttgctgccaccgtcagccataaagccgatcacggcagacagggaaagcctgaacggggcagggacatcacagctgggaagctgcataacgatactgcatatggatttaccggcttgacatcggacaccggtctcccagtggttgtgcaccgcgtacccctgacttctctaacgcctaaagacattgccgatccagacagaatccccgatacaaccctgagggggtccctctggcaggcgactcgggacctgtcaggaaaggagttcgaaaaagctcttttggatttcagtcgtacccatgcccaatttaagggcatacgccgagtcagagtgagggagggtctgacattaatcccgattcggaatcacgcaggcaaaccttacaaggggtatctcggagacagcaacgcccgctacaacgtttggcagatgccagatggcagatgggtgcaccaggtcatctccaccttcgacctgcatcaacccgggtttattgagcagaggcctcaccccgctgcaaagaaagtgctttctctgcggcagaatgatctaatcgccatagaacgagacggagcgctcagacagattatgcgcgtacaaaagtatggccagaacggtcagatcttcctgattgagcataatgaagctgggaacatggccgagaggaataaaaacactgatgacccatttaagttctacggacctggcgcaagcgccttgcggaatatgaaagctcgtcaggtgagaatcgacgaactgggtaggatatttgatcccggcccacgctga

SEQ ID NO: 2684 - RNA, 3213 nt, synthetic construct
  misc_feature 1..3213: note = Cas9 variant
  source 1..3213: mol_type = other RNA
atggccaaggacttcgagtacatcctgggcctcgatcttggggaaaccagcattggatggtccgtggtcagactgaacgagggtgttcccgaacacttggagaggttaggcgtgcggatatgctctgacgggcgcgatgctcagtcacatgaacctctgagtgtagcacgacgtatcgccagaggactaaggcggcgcagagacaggtatattcaccggcgcatccgactcacagatgtgctggtcaaatacggccttatgccagaggacattaaggagaggaaaaagctgcaagcgttgaatccgtatagactccggagcgaagctctggatcgtaaactggagccctacgaactcggtcgcgtgttatttcatatcaaccagagaagggggttcaagtccaatatgaagactgaccggaaagattctgagtcgggagccatgaagcaggcaatactgaaaacgcgagccaagatggaggcttcaggcgcacgcacccttggcgaatttttgtatttcctgaacaaagacaagacaagcactcaggagtacgttcctgtgagaatgaggagtcactccgaaaagaataaaaccgtctatgagatgtacccagatcgggccatgtacgaagacgaggtgcataagatctttgagcaacaggaactatctcccgaggctcagacagaaattttcaacaccatctttttccagcgccctctcaaaccagtagagctggggttttgtgagttcgaagatggagagagaagggcctatactgcgagcgttgtgtttcaaaagttccgtgcacttcagcagattaatcagatctacgtccaagacgactatgaacggcgacccctgacaaaagaggaaaaggatatattgaaacactttctcctggaggacttctccgccttagataagaacggtctgctcacctgggctaaggtgagaacgcttctgaaattgcagaagaaaaagttcaatctagaatcagagaggcgcaaaggcctgaacgccgacgtgaccagttggaagctcagcaatgcagcttgctttgggcgggagtggttctctttttccgatgccaagaaagaagagattgtcgcgctgatcactggagccgaaaaggaggaggaacttattgcagagctgaaaacaaagtacggcttgtcagacgaaagagctaaaaacactgccaatgttagcctccctgatggtgtggctagtctgtctgccaaggcaatgaagaaattaatcccattcctggaggaagggatgctatatgacgatgccgtaaagcaggctggatacgtgttttccagctcgttcaaaggcgtcctcccggagaagtatgagacctttatcgaacccgagtctggcgaatgtttcgacgagctgccttactacgggcaagtgcttaggcgctatgttttgggaggtgtgccatccgaagagaacaaactgtttcccgagaagtactatggcaagattaataaccctacagtccacatagtgctcaaccagctgcgaaaacttatcaattcactggtagcgaagtacgggcatccacggaaaattgttgtggaaatggcacgtgatttgaagctcagtaaaaagcagaaagacgccatcgctaaggagcaggccctgaacgaaagagagaataagaggataggagcagaattagagcgcctggacattcggaacaattatgataacagaatgaaatacaagctatgggaggacctcagcaccgatcccacgaaaaggtcctgcccgttctgtggcaagcaaatctctcagcaggacatctttagccctgagttcgaaattgaacacctgatccccttttcacgaagtttcatggatggtcgctccaataaagtccttagctgccggagatgtaacagggagaaggggaataagactccattcgaggcctttggcaacgactctacacgttggaatgctattatgggacgcgtggaatcattgcctgagaacaaacggtggaagttcgccagtgatgcaatgagcagatttgaaagggacggcgatctgctcgcgcgaatgatgaccgacactcagtatatggctcggatagcccgcagatacctgtgctgtgcagccaatcccaaccaagtctacgggatcccaggacagttaacagctaaactgagggagcattggggtcttaattccattttgtctgatcagaaggaaaaagaccggtcggatcaccgacaccatgccatcgacgcattcgtggttgcttgcaccgacagaggcacgctccagaagtatagcaccgagcgcagggattacgccaagcccgagatgccttccgaaaaagcgccacacatcccgtttgccgacttccgtctgtcagatattaagcgggtgtttgacgagataatcgtaagtcataaacccgatagagggaacgctagggcagccattctaaagggaggcacagtcgctaaactgcacgaagagacttattacggtatgggaggcgaaggatctaagaagggcacctggaaactcatccaacgcattcctgtgagcgagatcaagaaagcctccgacctggattgtcttatagaccagaaggggacagcaaacccattgcgagttctgttagtgggagcgtcagagagcgaacaggagcagatcattgcctcttatttcgctagacggggtactcataaagtcaggacctaccgcgaacgtaataaggatgtgatcctcccctttaaagacaaggatggcaagctgtatagatacgccgtatacgggtccaacgcatatgctgagatttactgccctgaccgggggaaaaatgccggcaagtggcaagtggaaatcataccaaactattgcgcacaccagaaaggtttcattcccaagtggaggcacacagatgcccatgctaaacttatcatgcgcctgtaccgaaatgacatggttgcgtatgagaaggaggggaagaccgtcattgccagagtgaaaaagatgggcggaaacggcgtgatcgtctttcggaatcacttgatagcaaaagaagagggggacaggctcagttggcaggctgttgtgagcggaatgcaatctgccaacctgcgcaagatctacgtggatgtactaggcagagtcattgacccgaaaaggcctatgactcagaatgaaacggatggtcaggacaactga

SEQ ID NO: 2685 - RNA, 3213 nt, synthetic construct
  misc_feature 1..3213: note = Cas9 variant
  source 1..3213: mol_type = other RNA
atgagccacttcagactgaagcagctcaactacatccttggcctggacttggggattgcctccgtgggatgggctgtcgttgagatagataccgaagagaatcccacaaggttaatcgacgtgggtgtacggacttttgaacgcgcagaggtgcctaaaacgggcgattctctggccgcggctcgacgtcaagccagatcagcaaggcggctaattcgcagaaggacccatcggctcctgcgcgcccgaagacttctgaagagggaagggatcttgcacgctgacgatctcaacgcagagggactggtcaaagagctgccaaatacaccgtggcagctccgggtggacggcttagatcgtaagctgatgcccaaagaatgggccgctgttcttttgcatctggtgaagcaccgcggttatctaagtcagagaaagaacgagagcgaaggggccgacaaagagctcggaaggctgcttgcgggcgtccatgagaatcaccaggcactgcaatcctctgaataccggactcctgccgagttggctgtgaagaaattccaggcccagtcgggccacattcgaaaccagcgcggggattatacccatacatttgacagaaaggatctccaacaggaactgcaccagttattcgcagctcagcaaaaatacggaaatccatttgtatcagacggtctgaagcagggcatcgagaccctccttatgcagcaaaggcccgccctgagcggggatgcggttcagaagatgttgggacggtgcactttcgaaacagaggagtttaaagccgcaaagcatacctatagtgctgaacgcttcatatggctaacgaaactgaacaatctcagaatccaggagaacggcaatgaaaggtgtctgactgcccaggagcgtggtcaaattatcgaccttccttacaagaaagctaagctgacctatgcccaggtgcggaaagaattgtccctcccagagaacgcatttttcaaggggctgcgatacggaaaggagaatgccgaaacagctgcgttaatggagatgaaagcataccacgccattagaaaggctctggaaaaagccggcctaaagactgagtggcagggcctcgcatgcaaacccgaactgcttgacgccatcgggaccgtcttttctttgtataagacagatgaggacataagcaccaggctgcagggacaactctccgaggatgtgattaacgctctgcttgccggtctgaatttcgacaagtttatccagttgtcactcaaagcactgagtaagattttacctctgatggaacagggccagcgctacgatgaggcgcacgctgccctatatgtgcggagcacgccacaaccgcagagactcctgccccagatcactgcagacgaaatctgtaaccctgtcgttcttaggacattgtctcaggcccgcaaagtgattaacgctatagtacgacggtacgggtccccagcccgtatccatattgagaccggaagagaggtgggcaagtcattcaaagataggcaagaaatccagaagcgccaggaggacaatcacaaggaacggaaacaagcagctgagaagttcctggaatattttcccaacttcgtcggtcagcctaaagccaaggatatactcaaactgagattataccagcatcagcacgggcaatgcctgtatagcggcaagactcttgacatttgtaggttgaatgagaagggatacgcggagatcgatcatgccctcccatttagtcgaacatgggacgactctttcaacaataaagtgctggttctagctggcgaaaaccagaataaggggaaccagaccccctacgagtggctgggaggtgcatccaatagcccgcgctggcaggaatttgtggcccgggtcggctcgtctagattccaccactccaaaaagcaaaggatcctcctgcgtcagcttgatgaggaagggtttaaagagcgcaacttgaatgacacgcggtatgtggctagattcctgtgcaagtttattgaggaaaacatgttactcctgggaaggggcaaacgacgggtattcgcctcaaatggtcagatcaccagttttcttcgcagcagatgggggctgaggaaggttcgggaggaaaacgatcgacatcacgcattggacgcggtggtcgtggcctgttccacagtcgctattcagcaaagaataacttacttcgtgcgccagagggagatgaatatctttgatggcgaactcattgacaaggagacctctgaggttagccgtccttatttcccccagccatgggatttctttcggcaagaagtgatgatgagagtattcggaaaacctgacggcgatccctcatttccagaggccgacacaaaggaaactctgtgcaccctactggagacaaggctcagttcccgcccccaggcagtccatgagtacgtgacccctctgttcgttagccgagctccaactagaaaaatgtctgggcagggacacaaggaaacggtgaaatcagccaaacttttgcacgagggtaagagtgtcctgcgggtgccgttaacacagctcaaacccaacctgcttgaaaagatggtaaacagggatcgcgagcctcaactgtatgaagcactaaaagagcgtctcgccgcttacggcaatgacccagcgaaggcctttgcaaccgagttcagaaagaagggagggcagctggtgaaggctgttcgggtcgaagatactcagaaaagcggcgtgttgctgcataagggtaccggggtggccgacaacgccacaatggtcagggttgacgtgtttgagaaatccggcaagtattacttagtgcccatctactcttggcaggtagctcaaggaatcctccctaataaagcagtcattcagggcaaggatgaaaagaactgggacgagatggatgaaacctatactttcaaattttcgatgtacccaaatgacctggtggagataaacacagggaagcagcgccttttcggatattacatcggcctggatcgagccacgggtgcgattagcatcagagagcacgacttggataattttaaagggaagaacggaatttatcgggttggcgtgaaaaccgctatctccttcaagaaataccagactgacgaactcggtaaggtcgtggttccctgtaggccgaagaaacgcctgcctgtgagatga

SEQ ID NO: 2686 - RNA, 3216 nt, synthetic construct
  misc_feature 1..3216: note = Cas9 variant
  source 1..3216: mol_type = other RNA
atgagactgggcctcgacatcgggaccaacagcattggatggtggctttaccagacagatgacggtactataacggatgtgctggacggcggggtcaggatcttctccgatggacgggacccccaatctaaggagtcattggccgttgatcgccgagtggctcgtgcacagagaaggcggcgcgacagatatttaaggcggaaagccgcgctgatgaagcgcatggctggcgccggtctaatgcctaccgatcaggcacacgccaaaaagctcgaaagtctggacccatacgctcttagagcagaggggctggattgcgaattgccgctcacacatctgggacgagccctgtttcacctcaatcagaggcggggcttcaaaagcaaccgtaagactgaccgcggcgataatgagtccgggaagattaaagacgctaccgccagattagactgggcgatgagggatgcaaaggcccggacatatggagaatttctgcatacccgacaacagaaagctgacgatcccaagcgcatgcctactgtaagaacaaggcttaccgtggcccggcgcgacaacgcagagaaagaggaagctggttacgatttctatccagacagaaggcacttgtctgaggaatttgatgccctgtgggcggcccaggcagactaccatgaggctctatcggatgacctccgtgatcagatcaagacgattatcttccaccaacggcccctgaagactcctgaggtcggcctttgtctgtttaccgacgaacgaagaataccatcagcccaccccttgaatcagaggcgcatcctcctggagacagtgaacgctttacggattgttgccagaggggaagcagccaggcgcctgactctcgaggaacgagaccagatcgtgcatgctcttgataataaaaaccacaccaagacactgagcggaatggcgatgaaattgaaggcactaggcaaagtcattcggctgcgtagtgaccagaccttcacgctcgagactgccaatagagatgctatcgcctgcgacctggtgagggcatccctttctcatcctgatcgcatgggtggggtatggacaaccctggacgagggagcccaatgggaagttgtgcagcggataagagctgtccagagcgattccgagtttgacgccttggtggtgtggctcgaacaaaaccacggcctggataatgcacacgcgcaggctactgccaacgcaccattaccggagggctatgggaggatgggactgatggccacacgacgcattctagctgccctccagtcagacgtcatgccctacagtgatgcagttgctgcctgtggttggagccattctggcgggcctaccggagaagtgctggagaagttgccatactatggcaaaatcttggaccggcacgtaattcccggtacgtacgatgagaataacgaagacgtgaagagatatgggaggatcaccaatcctacagtccatatcggcctgaaccagattcgtcgcctcgtgaaccggataatctgcattcacggaaagccagacgagatcgttgtggaactggcgagagatcttaaaaattccgaggaccaaaagagggaaatacagaaaattatcaagaaaaacactgatgccgctatcaagcgaggcgagaagctgattaatgagttggggcagaaagacaccggagcaaaccggctcgtcctgcgcttatgggaagatctgggtcatgacgtgatgacaagaaattgtccctactcaggcaagaggatcagcgccgggatgctattcgatggaagttgcgacgtagatcacattctcccgtattctcggactctggacgatggcatagctaacaaaaccctttgtttgaaggaggccaatcgacagaaatccaacaatacaccttgggaagtttggggtgagaccgagcaatgggacactatcgcagcgaacctgaagaatctccccgataacaaggcctggagatttgctagcgacgccatgcagcgcttcgaaggggagaatgacttttcggcaagggctctgaaagatacgcagtacttatctcgtattgcccgggcatatctggacgccctttacgatggcggagacggcaactcccacgtgtgggtcgtgccagggagattgacagaaatgctcaggcgccattggggactgaatggtctagaggctctgaccgattcagacgaaaacactgtcaaggcgaaaaaccgaatggatcacagacatcacgccatcgacgcagctgtggttgccgccaccgatcggggcctcatccagaggattagtaagatagctaaacgcgacgagcaagcaggggccgaggaagtggcgcgtagcgtatcccctccctgggatggattcagagacgacatcgctgcccagctgtctcggattatcgtcagccacagggcagatcatggccgcattgactcacaggccaagcagcaaggtgaggatgctacagcagggcagcttcacatggacaccgcctacggcgtggttgatgcgggacgagtggtcagtagaaagccattgctgtccttaagcgaatctgacatcaaaaagatacgggatcccgacctccagaggcatctgactcgcgtgacaaaaggccttgataagaaagagttcgaacacgctctgtcagactttgccaatgcaagaaagttgcctgatcaaagtgagaacccatatttcgggatgaggcgggtacgtctcatcgacgccctgcaggatagcgctcgcgtgtccgttcgagacagagacggacatatttacaaagcctataaggcaggctctaatcactgctacgaggtctggaggctaccggatggtaagatcaaaccctgggctatttcgacgtttgaagcccaccagaccgggactgagagcaagcctcatccagcggccaaacggctgctccgcgtgttcaagagagacatggtggcaatcgaaagggatggagagacactgatgtgttatgtccagaaaatggacatagctaacggcctttttcttgttccccacaccgaaggtaatgccgatgctcggaaccgagacaaggatgactccttcaagtttattcaaatgtcagcagtgagtctgatcagagccaaaattcgcaggatccatgtggatgagatgggccggttacgtgaccaggggcctccaagatga

SEQ ID NO: 2687 - RNA, 3216 nt, synthetic construct
  misc_feature 1..3216: note = Cas9 variant
  source 1..3216: mol_type = other RNA
atgagatacaccatcggcctggacattgggatagccagcgtgggatgggctgtcatcaacgaggataagtccaggattgaagacctcggtgttcgggtgttcaaaaaggcagaggaacccgatggcaaatctcttaatctggcccgccgagaggcgcgtgggtcaagaaggcggatccgcagaagggctacacggatgcagaaggtaaaagaattgttagtgaagtataacctggtcagtgagaaggagctagaaactctctacattatcacggagaccacacctgacgtgtatgaactgcgcgccaaaggacttgatcgactgttgagcagacaagagtttgcaagggttctcactaatatagccaagcggcgtggctacaaatccaaccgcaagatcgacgaggaagataaagaggtgggtaagctgtctaaggggaccattgaaaataaaagaatcctgcaggagaagggatataggacaattggcgaaatgttctacaaagacgagaagtttgagtataacaaacggaataaggctggcgaatacaactcgaccgtcctccgatcaatgttaatcgatgaggtgcacactctgttcgaaatgcagcgcaaatttaagagcgagttcgcaaatgaagagtttgagaaggaatacgtagaggttatgacatatcagaaaccatacataaccccggaacttttggagaagatgctggggaaatgcacgttcgaaaagggagagcccagagcccctaaaaacagttatacttttgagaggttcatgctactccaaaaggtgaataacctgaatatttacatcaacggtgaaaaggtcgagattccacaggagaaaaagaaagaaatcatcgagcttgcttataagcagtccgaaattaaatacacccagctgcggaagaagttggagctccccatagaagcccgctttgcggacctgaattatcaaatcaaaagaacagaggatgaatctgaggaggcattagtgaagaaaattgaagacaagaaattcgtgaagctggagggctggcataagatcaggctcgcccttaaagaaaacaaggataaatttgagaagatagagaaaaaccctgaactgcagaatattatcgctgacgccttggtccgtaacaagactgacgagaccatcaaaaattacctagaaaagagcgatattgacgaggaaatcattaacgcaatactgaatatcaacttcacaaagttcgggcacctctcctacaaagctatgaataagattatcccagagctggaaaaaggacttacctatgataaggcctgtgagaacgttggctacgagtttaaaggtcggaagaatgaactgcagtataagttgccccctgtgacggagctcgaagacgagatcctgaactcagtagtgttacgagcggtcagtcagactagaaaagtgattaatgccataatcgataagtacgggagcccaacagcaatttatatcgagaccgctagggaactgtctaaaccgtacgacgagcgcatgaagattgaaaaacggcaaaaggagaacgccgctaataacgatcagatcaaggaatatataaaagagactttcggatttgaccccaagcctttcgatatcgttaaaatgaagctatggagagagcagaatggcaaatgcgcctactcctcaaagccaattcccgcagaaaggctctacgaggaaaactttgtgcaagtcgaccatatcattcctttcagccgctgttttgatgacagttatcagaacaaggtgctggtacttacagacgagaatcagaaaaagaaagaacgaaccccattcgagtactttggcgaggataaggaacggtggcaccagttcgaggaatttgttaacttgacgtataaattcaatacccgtaagaaagagaacctgctcatcaagaattttaacgaagagaagtctaaagagtggatacaaagaaatattaacgacacaaagtacatctccaaattcatgtataattacattgccaacaatctgaagttcgctgatagcgaatcgaaaaggaaggtgtataacatcaatgggcaggcgacttctatacttcgccattactggggactgaagaaagaccgggaggaatccgataagcaccacgcacaggacgccgtcatcattgcttgcgccaccaacaaaaatatcaagaaagtgtcagattacagtagaaggaagttgctctataagaacaacgagattatcgacgaggaaacaggtgagataattgataaaaagtacaatatcgacatcagcattaaagaaccctggccgaagtttcgagaggaagtcgaggcacgcatggaggatgccgacaacaatggccagctgtatgctttaatcaacgggaatttcactaactacgatgacgtggacattacccatataaaacctatctttacatcccggatgcccgaaagaaagattaccggaagggcccacaaggatactatgcgttctcaaaaattcatccagcagggccagaattttacggttgtgaagaaaccactgaaggcaattagcaaacaagagatcgaaggtataatcaacaatcctgacttcaagaacctatatctctcagataagaaactgtacgacgatatttatcagaagatgaaagaggcggactttaaggctgaaaaagccttcgcaaatgagtaccgcaagtacagtaaaaacggcaattcccccatcgtacggagcattaaggtcgcctctgctggggccacaggagtgcagcttaagaacggcgcaatcgctgagaatgccaacatggttagagtggatgtctttgaaaaagacaacaagaattatttggtgccaatatacgtatcagatttcgcgaaaaacgagctgcccaataaggccatttgtgctaacaaagacgaaaaggagtggatcgaaatgaccgagaagtataaatttaagttcagtctctaccctaatgatctggtgaaaatcaagaggaaaaacgagaaggaattttatgcatactattgcagcactcatcgagggaccggaaatattaacttactgcttgttaatggtgaggcccggaaggacggcgtcgggatcaaaaacacagaaatattcgagaagtaccaggtggatgtgttgggaaatatttccaaagtcaacaaggagaaacgcgaaggcgttaagtga

SEQ ID NO: 2688 - RNA, 3216 nt, synthetic construct
  misc_feature 1..3216: note = Cas9 variant
  source 1..3216: mol_type = other RNA
atggactacagaatcggcctggatattgggaccaacagcataggatggtccatcattgagctcacaactgtgcagtctaaacttgacggtaaatataggctgaaggccgtcggcttgatcgatgctggggttcggatgttcgaccgcgcagaagtgcccaaaacgggagcctcattagcgctgcctcgacgtctagctagaagtagcaggcggcgcctcaccagaaggtccgcccggaagaaagcaattcgcaatctgcttgtaaaggaggatatcctgaaccaaatagaattggaccacctctaccgaacatctgagctggtggatatctggcagattagagtcgaaggcctggagaggcggctcggtcgtcaggagtgggcccgcttactgatccatcttgggcagaagagaggatataggtcgactcggaaagctgaagagggcgcagacaccgaaggccgagccgtgttgtcaagcattaaggagaatcaagagacactgaaacagtaccgcaccgttggggaaatgtgggctactgatgacaagtttaaaggaagagtgaggaacagtacaaatgagttcatctttaacgtctcccgggataatctagaagaggaaatacgcttcctctttcagcagcaaagagagctgggttctatgtatgccagcaaacttctggaggaatcctacatggaggtgtggggccaccagttgccattcgcgtcaggggaaagtattctcaagaacgtaggaacctgcagcctgtatgagaaggaaaagagggcagccaaagctacgtacacttttcagtacttcatggccttagacaagctgaataacgttcgtatcctcccgtctatgcggaccctttccgaggaggaacgaggcctggcattgaaagctatgtttgagagagataagctacccaaaaatcctccaaagttcacatattcacatctgaggaaggccattaaactcgaagaggacgaaacttttcagaccatcagctacgacgtggagaagacactggcgaccaacgagagtgccgtcttcgtgaatcttgcagcttattaccaaatcaaaaaggtgtgtgatgaacacaacgagaattatgactacgtcgattataacacgattggtcatgccctgactgtttacaaaacagacgaagatataaacaagtacttggcttctaagaataacatcgccaaacgcgtgtatgcaaatgactttattgattccgtactcaagcacagctacaccactttcgggcacctgtcgttaaaagccctgtctcggatcatacccctaatggaggagggagaagtgttcgctaaggcgaaagagaaggcaggctttaaggaagagtcctatctcgaaattaaatcaaagctgcttacaaacatccctgacgccatcaaaaatccagtcgtgatgagaagtttgacccaggctaggaaggttattaacgccatcattaaacgcatgggcgagcagcccgcaagcatacaaatcgagctggcccgagaactctccaaggatgtgtctgagcggaagaaaattacgaatgggttcgctgaaaaccgtagcagaaatcagtttgccatcaagaccctggaggaaaaccatatcacaaatattaggggacaggacatagtcaaattcaaactttggcaggagcaaggtggccgctgcgcatactcactgaagcctatcaagttggaggaactcattagttttctgaaaaaggagcggagatatgaacacaacttagatgtggaccatatcattccatactccaagactttcgacgatagctataccaataaagtactggtgttttctgacgagaacaggaagaaaggggatcagatcccggcggaatacctaggaataggcacaaagcgatgggagaaatacaaggagttcgttatcacttcaaagtttcccgctagtaaaaagaaacgcctcctgaaggaacagcttgtcgagcgggaagagttgttcatgaaagagagacacctgaatgacaccaggtatgccagccgttactttatgaacttcctccgcgaaaacctgttacggaaggagacagtgctgcacgaaacccagtgggtcactgcagtggccggtagagttacgtcccatattaggaagcgacttgggtttggcaaagatcgggaggaaacacacttgcatcacgctctcgacgccatcattgtggcatgtaccgataagtggatgatcgactgcgtaactaattattacaaatctcgcgagggaggctcgataaagagaaaagagattaggttccctagcccatggaacgggttctggcatgatgtccaaaccaagctggctcagctaccccagcctgaagtgatcaatgagtccatttcaaagggaaacccagacgccgttgattatatgctggtgagtcggatgccccgaaaatctatcacaggtgcggcccacaaggaaaccataagcaaatggggcgggtacgacgataagggaaaagctctcctggtcaagaaagtggcactttccgagttgaagtttaagaatgacgacttcccgatgtataacaaagaaactgatcctctgttatacgaggccatcaagaatagatacgtagagtcaggccgcgacgtgaaaagggcttttgccacacccctctataagccaagcaaatctggtaagcgtaacgaagttaagcgggtcaaagtgattgcagagaagaaagcgatggtgagagaagtcaatgggggcatcgccgagaacggaggcctggttaggtccgatattttccttaaggaaaagaagtacgtgatggtgcctgtatatacgtttgacaccatcaagcagcaactgcccaataaatacgtcgtgagtgggcgcggatatgagcagtggccagagttgactgctgaacacgttttccagtttagcgtgtacccctatgagctcgtccatgtgggtacaaacaagggcgataattctttctactactttgcctccctgaacatatcaagtaatgttctaaaattcagcgaatgtaaccgacctaccaaggactatattgagatcgggctgaactcgatcattctcctggagaaatacgaaatcgatgtgcttggaagaattacaggccagtccaagaagggtatacggcaatcttttaaaaataacaagagccagatgaaagagtga

SEQ ID NO: 2689 - RNA, 3219 nt, synthetic construct
  misc_feature 1..3219: note = Cas9 variant
  source 1..3219: mol_type = other RNA
atgagactgggcctcgacatcgggaccaacagcgtgggatggtggctttacaagacagatggtgaggccgcttccgcaaggattgtcgaagttatagacggcggggtgcggatcttctctgatggacgcgaccccaaatcaaagactagcctggccgtagatcgacgtgtggcgagagctgccaggcggcgcagagacaggtatttgcggcgccgagcaagtttaatgaaactgctagccagaacgggcctcatgcctgctgatccagtcgaggcaaagaaactggaaaggcttgacccgtacgagctgcggtccaccggtttggatgacgccctccccctgacacactttgggcgtgctctgttccatctcaatcagcgcagaggatttaagtctaacaggaagactgatcggggcgacaatgaaaacggcaaaattcgagaggccaccgcgcgcttagatctggagatgatgacatcgggggcaagatcatatggagagttccttcacatgaggcggcaacgcgccagcgaccctagacatgtgccaagtgttaggacccgtttgtccgtggctgcccggggtggccccgacgcaaaggctgaagccgggtacgatttttatcctgaccgacaccatctggaagaggagttccacgcgctatgggccgcacaggctactcaccatcaggccctcacagatgacctgagagatcttgtctttgagaaaatcttctaccagaggccactgaaggaacccaaaattggattgtgcctctttaccgctgaggaacgcatcgccaaggcacaccctctgacgcaacggagagtgttattcgaaactataaatcagctgagggtaaccgccgacggccgctctacacgaccactcactcttgaggagcgggataccctggttcatgctttggacaacaagaaaccgacaaagagcatgacctccatgaatatgacgctaaaagcgctggcaaagctcctgaaacttcgtgatggtgaaagatttactctggagacaggggtgagggaaaacatctcatgtgaccccgtccgcgcctgcatggctcaccctgcccggttcggaccacagtggagtagcttggattgggaggcacagtgggacgtgatttctagagtgaggcaagtccagtccgaaggcgagtttatcgagctcaccgactggctgattcagggccacgggttagatgccgaccatgctaaggccgttggaaatgcacccctgcctgaaggttatgcgcgactaggcttctcagctactgagcgcatcctcgatcagctgaaagccgaagtgtgtacatacagcgacgcagtagccaagtgcgggtggcaccatagtgatcaacggaccggagcttgtcttgaggtgttgccatactatggcgaagtcctggacagacacgtgatacccggtacgtacgatgccaccgacgatgagattacaaggtatgggcgtatcactaacccgaccgttcatattggcctcaatcagctgcgccggcttgtgaacaagatcatcgaggtccacggaaaacctgaccagattgtggtagaactggcaagagagttgaagcaatctgaaccccagaaaaaggatgctatgaaaaggctccgaaatacaactgccgacgcgatacggcgctccgagcagctggagcagttaggccaaccaaacaccgggcacaatagaatgctgctaaggctctgggaagatctgggacctgccatcggtccccggtgctgtccatacacaggcaagaccattagcgttactatggtgttcgacgggtcgtgcgacgtcgatcatatccttcccttttctcgaacgttggacgattccttcgctaacagaacactgtgtctcaaggaggcaaaccgcgaaaaatcagacaggaccccttgggaggcctggggaggcactgatcagtgggacgatatagctgccaatctgaagaacttaccagagaaaaagcgtaaacggtttggtccggacgcaatggaatggttcgagggggaaaatgattttctggacagagcgcttgtggatacccagtatttggccaagattagtaggatgtacctcgacacactgttcaccaagggcggacacgtctgggtggttcccggccgcatgactgagatgctacgaagacattgggggctgaacgctctcctgaatgataaagaccggggagccgtgaaggctaaaaacaggacagaccaccgccaccatgcaatcgatgccgcagtagtcgccgctacggactatcgtcttatgcagaagatcagcagagcggccggtcaaggcgaaaatgcagggcagtccgctgagttgattgcccgggataccgacgccccttgggaacactttagggctgatatcgcatctcagctggagaaaattatagtgagccatcgcgccgaccacggacgaatcgatgttgagggcagaaagactggtcgggactcaacagcggggaggttacataacgataccgcttacggcgtgattgacgatctcacagtcgccagtcgcactccactgatgtcccttaagcccagcgacatcgcaatcaccgaaagaggcaaaaatattagggaccctcagctgcaaaacgccttgtacgtggctacgaagggaaaagaggggaagatgttcgaacaggcactcgtagattttgcctctaaagagggaccatatcagggcatacggcgtgtgcgcctggttgaaaccctacagaaggcggctcgagtcgagatcggtaaaacagagtcagggcaacccctgaaggcctacaagggagacagtaatcactgctatgaactctggaaactgccggatggcaagattgtgcctcaggtggtcactacctacgaggcacacgccggtagcgctccaagaccccatcctgccgcaaaaaggatccttcgggttttcaagaaagacatggtgaagttgacaaaggatggcgaagagattgtggggtatgtacagtccatgcacatcaaaaacggactgtttgtcgctcaacatttagaggccaatgcggacgcccgcaacagagataagactgaccccttcaaatttctccagatgggcgcagggaccctggtgaagacgggacttaggcgggttctggtggatgaaataggccgactaagagacccaggtcctcccaaactctga

SEQ ID NO: 2690 - RNA, 3225 nt, synthetic construct
  misc_feature 1..3225: note = Cas9 variant
  source 1..3225: mol_type = other RNA
atgcagaccaagaacctgccctacacactcggccttgacatcgggatggccagcgtgggagctgcactgttgttacctgatcaagagaggattctggccctacacgtcagaactttcgacaaagcggaaacggctaaggagggtgaatccctcaataaaatacggcgcgattctcgactgacccgtagaaggatccggcgcagagcccataggcttgttcggctggcacgcttgatgaagcgagtgggcctcattgccgacgctaacccagaggcatttgccctgccgggggtatcaccctggcacctgagagctgatggactcgacaggttactggaacctaaagagtgggccggcgtgctttatcatttggtcaagcaccggggtttccagagtaatcgtaagagcgaggcgaaagcagatgaaaaggccgggcagatgctgtccggagtgggccgcaaccaggctctactcaaagaggccggctacagaacagttggggaactggcagctaggcatgaggactttaaggaggccaaacggaataagggaggttcttattcgcacactttcgcgcgagccgatcttaacgcagaactgaatttgctctttgagcgccaaagagctctgggctcaaggttagccagcgctgacttccaggaaaacgtgcgggatctgctcatggcccgcagaccaacccttagtggggcaaatctgttgaagatggtcggaaaatgcacatttgagaagtccgaagacagggcccccaaagctggctaccgtgcggagcggttcgtgtggctaggtaagctgaacaatctcaaaatcgtagggtctggagatgcacgacctctgaccgacgccgagcacagaattgttatcgaccttccatttactcaggctaagctgacattcaaacaggtgaggaaggccttggaactcgagacccatcaacgctttaacctgttaagctatcggcccgatcctaagggcaaagacaaggatccagaagagtccacgttctttgaagcaaaatcattccacactctgagaaaggcctacgagggcgctgggctaaagaaggagtggcagagggacgccctcgatccggaccgcctggatgcacttgcgtatgctttgacctgttacaaggacgatacagaaagtcgacagtggctggtcgcccagggaataggtactcccatcattgaggcagtgctcgccgagagcttcgacaaatttatccatctgtctcaaaaggctcttaaagccattctgcctcacatggaagcaggccagcggtacgatgacgctgccaagtccgcggggtatgaccactcacagccagatgccggaaccggcaaacgtgctacattgccccctccagacaaggataccatcagaaatcccgtggtctacagggcactcaaccaagcccgcaagctggttaatgctatagtggccgaatatggtccgcctgcagcggtacatattgagttagcccgggacctgagcaaacccatcgatgagagaagggacattgaaaaggggcagaaagagttccaggctctaaaggaaaaactcgccgcagcttttgaggagacgttccaccgaaagccaagtggcctggatcttttgaagtaccgcctgtttcgggaacagctcgaccaatgcccttattgtcagaaagccctggtggtcgatagattattcgagcccggatacgcacagatcgaccatgccctgccatattctaggtcctttgatgacggcatgaacaacaaggtggttgtgcacgtcgcttgcaatcaggataaagggaaccgtactccctacgagttccttgacggagcgggtgacagcgaacgctggcaacggtttgtggcctgggtacagggcaataaggcaatcagacaggctaaaaggaaccgattgctccgggttaatttcgggacagatgaagccaaggagttttcgaaacgcaacctgtctgacaccagatacatttgtagggagttcaagcggactatagaaacacagtttgcctggcattccgatgctgagggaaatgaacgatgcgtggtcctatcaggccaactgaccagtctcctgagagcacgctggggtcttatcaaggtgagggaggacggggatttgcaccacgccctggacgtcgcggtgattgctgccgcaagccgttccttagttaaacggatggccgattattctagaaggaacgaactcgagatggtgcgcaatcgatacgtagaccctgctacgggcgaggtcgtggatgttgcagccctgagacagatcgaagaccatttcccaaagccgtggccccttttccgggaggaactgttggcgaggctcgctcctgagccaaaactgcagctaacctgtgtgagctcatatgatgaaggactgcgcgagagtatacgtcccattagagtctcccgggcccctacaaggcgcggcctcggggcagcccaccaggagactatccgaagcctgagagacggatctcaatcagctatcaagaccccacttcgggatttgaacctgaaagacttagaaaatattgtgggttttgagagggacacagccctcatcgatgcaattcgcactagactggaggctttcggcggggaaggaaagaaggcctttgacgataaacagcccccgcttaggaagcctagtaaagacccagataaggcgcccataatccggagcgtaaaactgctagtgacccagaagtccggcattcctatccgtggtgggatcgccaacaatggcgcaatgctccgctctgacattttcacaaaggctggaaaattttacgccgttcccatatatgtcgctgatgcagtgcgaggcgagctgccacatagagccgtggcccaagctaagcctgaattggagtggcccatgatggacgaatcgtaccagttcctgtttagcttacacccaaacgattggatgaccatcaggctcaaaaatgaggtccgggaagggtattacgcgggactggaccgcgcaactggcaacatttccctttggctgcacgatagaaaccagaatgttggtcagaaggggttgctcacgggaaacggcatcaaaacagccctggctgtggagaagtaccatgtggacctactgggtaaacttcacagggtacataaagaggaacggcaaccgattcacatcaagcctggcaaacgatga

SEQ ID NO: 2691 - RNA, 3234 nt, synthetic construct
  misc_feature 1..3234: note = Cas9 variant
  source 1..3234: mol_type = other RNA
atgaagtacagcatcggcctggacattgggatagcctccgtgggatgggctgtcatcaacgaggatattgaaagaatcgaggacctcggtgttaggattttcgatgtggcagaacagcccaaaaccggcgcctctctttcaacacctcggcgcctggcgcgaagtactcgtaagagattgaggcggcgcagacacagggtagagcgggtgcgcaaatttatgatccaaaaggggttactgacgcaggtccagatggaacagctatatgactggaaagatggagacctcgatatatggctggtgcgagttaatgctcttgagagaaagctgagcgacagggagttcgcccggatcttggtgcattttgcaaagaaccgtggcttccaatccaatcgcaaatctgaactccaggaggaagataacggtgccgtcctgtcggctgtgcaggagaataagagactgatggaggaaaaagggtaccagaccatttcagagatgctcttatatgacgaaaagtttgagggaacaaaaaggaacaagggcggcgaatacactcacgtagttgcacggagcgatctgaagcgagagatccaacttattttcgagaaacagcgcgcctatgggcatgcttttgccaccatggaaaatgaggacaagttcttgcagatctggagttcccagagaccatttgcgacaaaagatgacatagcaaagaaaattggaaactgcaccttcgaaccgaaggagaaaagggcccccaagtctacttacacatttgaacggttccgcgctctggacaagctaaatagactcaggatcctgagcggtacctcccctgcccgttcacttacgcaagaggagcgggatctgattttgaacagtctctttagcaaaaaggaagtgaaatataaggagctgcgaaaattactgaagctcaatgacgaacagagattcaacgagatcttctacgatccaaatgaaaagatcgagaaaaacgagaataggacttttctttctctggaatcccagtacaagattcgcaaaatattgcaaaagatcgagggcaaatcactaaacgacacctatcggcccgtcgatctggacacaattgcatacgctctcactgtgttcaaggatgaccaggatatcagagactatctgcagaaccagtacgtggccagcaatgggaagaaagaacttaacctggcgaataggaagtataacgatgagttgatagaggaactcctgcacttaagttttaccaaattcggacatctgtctctaaaggccctccgcaatattctgccttttatggagcaaggcatcccataccaccaggcatgtgaaaaagctggttatcagttcaacaagaaggtcaatcgagagaaacagaaacttttgccccctgttccagccaaagacatcgtgaacccggtagtgattcggtccctgagccaagtccgtaaggtgatcaatgggattataaaaagatacggatcgccctcttccatctacattgaactcgctagggagatgggccgcggctataaggagcggaaagacctggaaaagcagtacaacaagaatagacagatgaacgagggggccaaaaagcacatccttgaactgaggcctgagtttggagatccacgaggtcatgacatcttgaaatataagctctggcaggaacaagattgccgctgtgcatactcattcaaaagtattcccataaagcagctgtttgagatcggctatgccgaggttgaccacattatcccttacagccggtccttcgatgactctaataacaataaggtgttagtcctggctgcggaaaaccagaacaaacagaatagaacaccatatgagtggtttgggcatgatgaaaccaagtggcaagagttcacgagcctagtgactacaatgaaagtatcaaagaaaaagaagagtctcctgcttaaaaagaactttgacgaagaacaggcagaggagttcaggtcccgtcacttgaatgatacccgctacattactcggtacatcaaaacattcatagaggacaacctgcagtttagaatcgaagagggaaagaaaacctatgttcacacggtgaatggcgcctacaccagcctcatgaggaagcgatggggtttcaacaagaatcggcaagagaacgctctgcatcacgccttagatgcagtcattgtggccgtctctctgccctttaaacataaggtgcgcgcttatttcaaaagaagggaagagtacgcccacaatcagcttaagcgggaaggggagtttttcccggaaccttggcccggctttatccatgagttggagattcgaatgatgcaggactcagaaaacatcaaactcgcaatggagagtctgaatctaaagacatatgatgagagcttcataaaagaactgaagccaatttttgtttccagaatgcctaagcgcgcgatgaaaggacagatccacgaagagactctcaagagggtgcgtggccggaccgacgacgggtacattagaacagtaaagaaggtcaaactggatcaaatccccttcgacaagaacggagattttccaatgttcggtaaggagactgacatgaaaacctatgaagctataaagtctaggtaccttgagtcgggcaaagataagaaaaaggcctttaatacacccttgtacaagcctgccaaaaacccagaaaatgcaccgatcattcgcagcatcaagattgaggaaaaagctaaccgagtggttatgctggacgagaagaccgccgcagataacgcttccatcgtgagaactgaggtcttccggcacaaagaaacggggaattatttcttaacacccgtgtacgtagccgacgtgctcgcgaagaaggttcctgataggctgataaccactaaaaagccatattcagagtggcgcaaaattaccgacgaatacgagtttcttttcagtctgtatcccaacgatttgatccgtgtcaagatgcctaaagagaaggaaacaaagacccatactggagagaaacacgtgtggcaggaaaattttatgtacttcaagggcgtgcattctggtagcgccggggtcagaatgatcgaccacatgaactcctttgaggatgaaattggcgttcggaaactcgtggtgttcgagaagtatcaggtagacccactgggaaggatgaataaagtccacggcgagaagcgccatgggatctga

SEQ ID NO: 2692 - RNA, 3234 nt, synthetic construct
  misc_feature 1..3234: note = Cas9 variant
  source 1..3234: mol_type = other RNA
atgaagtacagcatcggcctggacattgggatagcctccgtgggatgggctgtcatcaacgaggatattgaaagaatcgaggacctcggtgttaggattttcgatgtggcagaacagcccaaaaccggcgcctctctttcaacacctcggcgcctggcgcgaagtactcgtaagagattgaggcggcgcagacacagggtagagcgggtgcgcaaatttatgatccaaaaggggttactgacgcaggtccagatggaacagctatatgactggaaagatggagacctcgatatatggctggtgcgagttaatgctcttgagagaaagctgagcgacagggagttcgcccggatcttggtgcattttgcaaagaaccgtggcttccaatccaatcgcaaatctgaactccaggaggaagataacggtgccgtcctgtcggctgtgcaggagaataagagactgatggaggaaaaagggtaccagaccatttcagagatgctcttatatgacgaaaagtttgagggaacaaaaaggaacaagggcggcgaatacactcacgtagttgcacggagcgatctgaagcgagagatccaacttattttcgagaaacagcgcgcctatgggcatgcttttgccaccatggaaaatgaggacaagttcttgcagatctggagttcccagagaccatttgcgacaaaagatgacatagcaaagaaaattggaaactgcaccttcgaaccgaaggagaaaagggcccccaagtctacttacacatttgaacggttccgcgctctggacaagctaaatagactcaggatcctgagcggtacctcccctgcccgttcacttacgcaagaggagcgggatctgattttgaacagtctctttagcaaaaaggaagtgaaatataaggagctgcgaaaattactgaagctcaatgacgaacagagattcaacgagatcttctacgatccaaatgaaaagatcgagaaaaacgagaataggacttttctttctctggaatcccagtacaagattcgcaaaatattgcaaaagatcgagggcaaatcactaaacgacacctatcggcccgtcgatctggacacaattgcatacgctctcactgtgttcaaggatgaccaggatatcagagactatctgcagaaccagtacgtggccagcaatgggaagaaagaacttaacctggcgaataggaagtataacgatgagttgatagaggaactcctgcacttaagttttaccaaattcggacatctgtctctaaaggccctccgcaatattctgccttttatggagcaaggcatcccataccaccaggcatgtgaaaaagctggttatcagttcaacaagaaggtcaatcgagagaaacagaaacttttgccccctgttccagccaaagacatcgtgaacccggtagtgattcggtccctgagccaagtccgtaaggtgatcaatgggattataaaaagatacggatcgccctcttccatctacattgaactcgctagggagatgggccgcggctataaggagcggaaagacctggaaaagcagtacaacaagaatagacagatgaacgagggggccaaaaagcacatccttgaactgaggcctgagtttggagatccacgaggtcatgacatcttgaaatataagctctggcaggaacaagattgccgctgtgcatactcattcaaaagtattcccataaagcagctgtttgagatcggctatgccgaggttgaccacattatcccttacagccggtccttcgatgactctaataacaataaggtgttagtcctggctgcggaaaaccagaacaaacagaatagaacaccatatgagtggtttgggcatgatgaaaccaagtggcaagagttcacgagcctagtgactacaatgaaagtatcaaagaaaaagaagagtctcctgcttaaaaagaactttgacgaagaacaggcagaggagttcaggtcccgtcacttgaatgatacccgctacattactcggtacatcaaaacattcatagaggacaacctgcagtttagaatggaagagggaaagaaacaatatgttcacaccgtgaatggcgcctacacgagcctcatgaggaagcgatggggtttcaacaagaatcggcaggagaacgatctgcatcacgctttagacgccgtcatcgtggcagtctctctgccctttaaacataaggtgtcagcctatttcaaacgcagagaagagtacgctcacaatcagcttaagagggaaggggagtttttcccggaaccttggcccggctttattcatgagttggagatccggatgatgcaggatagtgaaaacattaaactcgccatggagagcctgaatctaaagacctatgacgaatccttcatcaaagagctgaagccaatatttgtttctcgaatgcctaagagagcaatgcgcggacaaattcacgaagagacactcaaaagggtgcgtggccggactgacgatgggtacatcagaaccgtaaagaaagtcaagctggaccagattcccttcgataaaaacggagactttccaatgttcggtaaggagacagatatgaagacttatgaagcgatcaaatcgaggtaccttgagagcggcaaggacaaaaagaaggcttttaatacccccttgtacaagcctgccaagaacccagaaaatgcaccgataatccgctccattaaaatcgaggaaaaggccaaccgagtggttatgctggatgagaaaacagctgccgacaacgcatcaattgtgagaaccgaggtcttccggcacaaggaaactgggaattatttcttaacgcccgtgtacgtagctgatgtgctcgccaaaaaggttcctgacaggctgatcacaaccaagaaaccatatagtgagtggcgcaagataactgatgaatacgagtttcttttctctctgtatcccaacgacttgattcgtgtcaaaatgcctaaggagaaaggaaccaagacacataccggcgaaaagcacgtgtggcaggagaattttatgtacttcaaaggtgtgcatagcgggtccgcgggcgtcagaatgatcgatcacatgaactcatttgaagacgagatcggagttcggaagctcgtggtgttcgaaaaatatcaggtagacccactgggcaggatgaataaggtccacggggagaaacgccatggaatttga

SEQ ID NO: 2693 - RNA, 3234 nt, synthetic construct
  misc_feature 1..3234: note = Cas9 variant
  source 1..3234: mol_type = other RNA
atgcagcaaaagccccagagatacatcctgggcctcgaccttgggattgccagcgtgggatgggcttgcgtctgggcagatgagaacgaacaccctaccggtctgttggactgtggcgttaggacattcgagcgggccgaagtgccaaaaactggggattccttagcgctggctcgccgacaggcccgttctgtaagaaggctaatacggcgcagagcacataggctcctgcggcttcgccgactgttgaagagagagggagtgctcctgtcagccgactttaatgaaaacggcctggtcaggggtctcccgatcgatgcttgggcattacgggtggccgggctggaccgtaaacttagtaataaggagtgggctgccgttttgctgcacctagtgaaacatcgcggatatctcagccagagaaagaacgagacgcaatccaaggataaagaactgggcaggcttctggcgggcgtcaatgggaaccgggaggcattgcagaatcgatctgacgaataccgcaccgccgctgagctcgccgtgaagaaattcgcagctgagaacaatggatcgctgagaaacaagggtggcgattattcacacacatttgacaggaaagatttacagcgggaactgcatctccttttcgagcgccagagagccctggacaatccctttactagcagtgaaatggaggcggccgtagatgaattgctaatgaagcaaaggtccgcactgcagggggaggctgttctcaagatgctgggacgttgcaccttcgagccttctgaatacaaagccgctaagaacacatatagcgccgagcggtttgtgtggcttaccaaactgaataacttgaggattcagtacaatggcgaagagagagcactctccgaagccgagaggcgcctgttactggacgagccatatcagaaggctaaactaacttacaagcaagtccggacaatcctcgaactgcccgagtcagcggtgttcaaaggtcttagatacgggcacggagaagacggcttgaaggcagagagtggcaccctgatggaaatgaaggcctatcacgctgtgaggaaagccctcaaggatgcagggctggagggagagtgggaaaaccgcattcgaaaccctgagcttctggacgccatcggtacggcttttagcttgtacaaaactgatgaagacatacgggccaatctcgcagcgttccgtctgtctgagaacgtcttagaggctctgctagccggcctcaattttgataagttcgttcatctgtcccttaaagcattggccaagatcctgccactcatggaacaggggatgagatatgacgaggcttgtaaggaagcctacggagatcactatggcgcaaaagagcaggaagaccataggctgttacccccttttgtggctgatgacattcgcaacccagtagtgttccggaccctgacacaagccagaaagatcgtcaatgagattgtgaggcgatacggttcaccgcttcgcgttcacatcgagactgggcgggaagtgggcaagagcttcagtgatagaaaagagatagaaaaacgacaggaggaaaaccgtaaggagcgcgagcgggcggccgctcactttaaggaattgttccccaattttgcaggagagcctaaagcccaggacattctcaagctgagactatatgaacagcaacatggcaaatgcctgtactctgggaaggagatcgacctcaggcgactgccagaaaaaggatacgtcgagattgatcacgcccttcccttctcccggacctgggacgatagctttaacaataaggtgttggtactgggtaaggagaaccaggacaaacgcaatagaacaccttatgaatacttagatggcaaggggaactcgggagcttggagggcattcgcggagcgggtttctggctgtcgatttccatatgccaaaaagcagagactcctgacccagaaacttgacgaaaagacggagcaaggtttcctggagcgcaatttgaacgatactaggtacgtggctcgttttctctgccagttcatcgaagagaaaatgcatctggaaggggccggcaagaagcgggtctttgcatccaatggacagatcacagctctactgagaggcttctgggggctcaaaaaggtgagggaggaaaacgaccgccaccatgccctggatgcagtcgtggttgcctgttcaagtgtgagcatgcagcagaaaattacccgacactttagatatcgggaggagcttgaacacatagacagggagactggagaagtaatccatggtttcccccaaccgtgggagttctttcgccaggaagtcatgacacgtgtgttctccgatgaccctgtttctgagttggctgagaagctggatagcagacccgaagcggtgcacgagtttgtcaccccattattcgtgtcacgggcccctcataggaaagtaacgggccaggggcacctcgaaaccattcgcagtgcaaagcgactggacgagaagatctccgtggttaaacttcccctgacacaactaaagactaaagacatagaaagaattgtcggatacccaaaccgggagcccgctctctatgatgccctggccgctaggttggcagcctttaaggacgatcctgcgaaggctttcagcgagccattttacaaaaccggcaaggacggtaaatgcggggtgctggtgaaggccgtccgcgttgaaaatgtgcagaaatctggcttactcgtgagaaaggatgagtcaggaaaaatgcagggcgtagcagacaacgccacaatggtcagggtggatgttttcgggaagaatggaaagaactacctggtgccggtctatgcttggcaagtggaaaaaggcgagcttcccaatcgggcagttgtggcctacgcggacgaggaagattgggacgagatggatgacagttttgagttcaagtttagcctgtatcctaacgatttggtagaagtcgtgactaaaaaggacaaattctttggttactattccgggttcaatcgtgctaccggagccatcaacatcaaggaacacgacctctctaaatcgaaggtgaagaatggcgtctacgagggtattggcgttaaaacagcacagagcttccagaagtatcaggtggataccctggggaaaactatccgcctatgtaagccagagaaacgaatgggatttaagaagaaatga

SEQ ID NO: 2694 - RNA, 3237 nt, synthetic construct
  misc_feature 1..3237: note = Cas9 variant
  source 1..3237: mol_type = other RNA
atgagatacgtgctgggcctcgacatcgggattgccagctgcggatgggctgtcataaaccaggagaaggaaaggatcgaggatcttggtgttcggattttcgacaaagcagaaaatcccaaggatggcaaatccctggccgcgcctcgccgagacgctcgttctaccagaaggacattgcggcgcaagaaacacagaatgcaaaggatcaaggtgttactggtaaagcatgggctactctcaaaaactgagctggatcacctttatgaaagtgccacggaggtggacgtctggaacctgcggttggatgcactcgagcgcaagctgtacccaaaagaatttgcccgaatcctgattcatctcgctaagagaaggggattcaaaagcaatcggaaggagaccacattatccgaaaacggccagatactggagtctatctcggagaatcagcagattatggaaaagcaaaactatcgtactgtgggtgagatgatccttaaagacaagaaatttgaaaatcacaagcgcaacaaaaatgggacctacgttggaacagtgaccagacagcagttgcaggatgagattcaaatgatcttccatgcacagaggctgtataagaacgactacgccactgaagagtttgagtcaagctatctagaaatatgggctagtcagcggccgtacgcctccaaagatcagattgagaagatgatcggctactgtacactcgaacccaaggagaaacgagcgcctaaggcatcttggagcttccaatattttgtcgccctgcagaccattaataaccttcgcctgatctccaaagacagaatcgaagagttgtcattcgaggaaaagaaacagattatgaatctcgctctggagaagagtatagtgaagtacatcgatattaggaaattactgagcgtaccaaacgaatttcaattcaattctctctcctattcagccgacacggttgacactgcagtggagagccggaagtgcatcgaacttaaagagtaccacagtataaacaaggtctataaacagatttacggcgagaacgctctgaatttgctacccaagtattacgataccatcgcctacgggctgacaatctttaaggacgataaagacattctcgaatatctgcagaacaagtacgtgaatgcgaaaggaaagcctatctctaacttcgccaataaaacttatgatgacacctttattcaggcacttctgaacttgaatttcacaaagatgggtcacctctccttcaaggctctgaaaaacataatcccatttttagaggaaggcctgagctacgataaggcctgtgagaaagctgggtataatttcaagggaacctcgtacacggagcaaactaaatatctacccgtgattcctcagaacacaaatccagtcgttcatcgcgccctctctcagaccagaaaggtgatcaacgcaatcattaaaaagtacggctccccgaatgccatacacatcgaaactgctagggagctgtcaaagacatttcaggaacgtaaagagattgacagtatgtaccaagataacagcaagaaaaatgaacatgcgatccacaaacttaaggagttgggtaacattaacccctccgggatcaatatagtaaagttcaagctgtggaacgagcaggacggacggtgcatgtattctggcaaatacatcgaacctcaccgactctttgaggaaggctataccgaggtggatcatattctgccatacagcagatcacttgacgacagttataataacaagacgctgaccttggggacagaaaatcagaggaaaggaaacaagatcccctacgagtatatgggtaatacttccatttggaacgatttcgagacccgcgtccagagcaataaaaagatcaacaagaaaaagcaacagaaactcctgttacagcacttttcttacgcacgggaacaggagttcatagaaagaaatctgaacgacacaaggtacgccactatttatctatcaagtctcatccaacagcatctgatttttagcgagtcctctcgcaagaaaaaggtgcacaccgtttcgggcatcataacaagccatcttcgatcccggtgggggttcaataaggatcgtaaagaaggacacatccaccatgctttggacgccgtgattgtcgcagtgacctcagatcacatgatccagagagtaactaagtactataaactgaaggagctcaacaggaatctgcaagccaaacgcatgccttttccagagccctgggaaggcttccggttagagctggaagctagaattagtccgaacacgcagcagtaccttaagggtttgaggtttaaaaactatgccgacgttaatctctctgagatcaagagcatattcgtgtcccgaatgcctaagcattcaattacaggggagctgcaccaggaaaccatccgcaaattcatcggctacaacgagaagggaaaagtcctaactgcaattaagaccaaactggaagatatcccctttgacgcgaatggcgatttcccaatgtatgggaaggagagcgacctctacacatacaacgctattaaggaacggtatctgtctcacaaaaaggataaaagaaagtcctttcaagagcctctttacaaacccaccaagagtggaggtataggcccattgatcaagagcattaaaatcatggacactaggacaattgtgaatcccgtcaaccaggggaagggagtggtttataattctaaaatcgcccgtacggatgtgttcaagaaagaggaaaagtactatctgatacctatctacaccattgacttaatgaagaacatcctcccacagaaagcaattactgccggcaagggttatgaggactggacaaccatcgatccgtcctttacattcctgttttcacttttccccaatgacctgatacagattgtacctagtaaaaacaagactatcaaagctcgcaccacggtcagcaagaaggaagtgttgctcccatcgctgaccgggtactttaaaggcgttcattccggaacagccggcatcactgtggagacccacgatgggtctgtcattgcaaatgtgggaagcaagcaactactgctcatagaaaaataccaggtagacgtgctgggtaactatacaaagatcaaagaggagaagcggattggccttactacctacaatgataacaaaaagatcgctgcctgttga

SEQ ID NO: 2695 - RNA, 3237 nt, synthetic construct
  misc_feature 1..3237: note = Cas9 variant
  source 1..3237: mol_type = other RNA
atgaagcagcaaccccagagatacatcctgggcctggaccttgggattgccagcgtgggatgggctctgatattggtcgatgaggaaggtaaccctatcggcttactggactgcggggttaggaccttcgagcgggcagaagtgccaaaaacaggagattccctagccctcgcgcgccgacaggctcgttctgtaagaaggctgattcggcgcagagcccacaggcttctgcggttgcgccgactcctgaagagagagggcgtgctgtcagcagccgactttaatagtgatggtctcccgaacttacccatcgacacttggcagctgagggtcgctgggcttgaacggaaattgacgaatcaagagtgggcagccgtgctgctacatctcgttaagcaccgtggatatctgagccagcgcaaatccgagacccagacagaaaacaaggagcttggctgtctgttggcttctgtggccaaaaattcgaaactcctgtcagaaaacgcgaatcagtacagaactcctgcagagttagccgtcaggctgttcgctgagcaaagcggccatctccggaacaaagggggagattatacccacacatttaatcgacttgacctgcagaaggaattgcatctactgttcgagcagcagcgcacctttggtaacccattcgccagtgcagaactccaatccaaggtggatggcctgcttatgatgcagagatctgctctgcagggggaggccgtattgaaaatgctcggaaagtgcacttttgaacccagcgagtacaaggcggccaaacacacatattccgcagagaggttcatttggctgaccaagttaaataacctgcggatcctagaaaatggcacggagcgcgctctcaacgaagccgagagaaaactgcttttggacgaaccttacaagaaagctaagctgacttattcacaagccaggaaactcctggatatgagtcacgacgcaacctttaagggtcttcgttacgggaaggatagcgagggactgaatgccgagaacggcgctttgatggaaatgaaagcgtaccataagatacggacagttctcgacaaagcaggcctgaagggggagtgggaaaaccgaatcagaaatccagagattttagacaaaatcggaactgccttctctctgtataagaccgatgaagacattcaggctgccctagcagatctcaggctgcccgagaacgtgcttaatgccttgctggctggtctcaactttgacaagttcatccagctgtccttaaaagccctgtcaaatataatgcctcttatggagcgcggcattcggtacgatgaagcatgtaaggaggtctatggggaccacagagcgttggctgaaagcaaaaaccagatgctcctgccaccgatccccgccaatgagattaggaaccctgtggtgctacgcacactgacccaaacgcgaaaggtcatcaatgcaatcattcggcgttacggaagtccacagagagttcatatagagactgccagggaactcggcaaatcttttaaggatcgcaaggagatcgaaaaacggcaggaggaaaacagaaaggagagggagcgagctgccgaacacttcaaagagctgttcccccactttgctggtgaacctaaagggggcgacattcttaagttgcgcctgtatgagcagcaacagggaaagtgcttatactccagcatcccaatagatctcggccggctgaatgaaaaggggtatgtggagattgaccatgcacttcccttctcgagaacatgggatgactcttttaacaataaagtactggtgttgggatccgagaaccagaagaaaaggaatcagaccccgtacgaatacctcgacggtgcctcaaacagtcaacgttggcgcgagttccaggcgcggctgcagggctgtagatttagctatgccaagaaacagaggatccaaactgctaagctagattccaaaacagaacaggggttcctggagcgaaacctcaatgacacccggtacatcgcacgctttctgtgcggattcattgaagagaaccttcacttgcagggcgagggtaagagaagggtctttgcctctaatgggcaaatcacggctctgttacggggcctctggggactgaagaaagtgcgagaagagaacgatagacatcacgcccttgacgcaattgttgtggcgtgtagcaccgtctcaatgcagcagaagataacaaaagccatgcagcgcagggaaactctggagaccgtggatacagagactggcgaagtaaagacccgtatccctcaaccctgggacttctttcggcaggaggttatgatgagagtgttcagtgatacaccacatgaggaactagctgaaaaactctccgggaggcctgaggccctgcacgactttgtcagccccttgttcgtgtctcgcgcaccaaatcgaaagatgaccggacagggtcacctggagactgtcaagtcagctaaaagattaagtgaaaacattagcgtggttcggaagcccctcacggccctgaaacttaaggatatcgagaatatcgtgggctatcctgacagggaaccagcactgtaccaggccttgcgcgagcgtctccaggcttataaagatgacccggtaaaggcgttcgccgaacccttttacaagcctgcaaagaacgggggacagggctccctggtcaaggctgtgagagttaaagatgtgcagaagacaggtgtcatggtgcggaaagaccgcgggggcattgccaggggaatagccgacaatgctaccatggtacgagtggatgttttcggcaagaaggggaaaaactatctagtcccagtgtacgcatggcaagtggccaagggaatcctgcccaatagagcggtcgttgcttacgccgacgaggcagattgggacgagatggatgactcttatgaatttaaattcactctttaccctaacgatctcgtggagattatctcgaagaaaggccggatttttggttattacagcgggctgaatagggccaccggagctatcgacataaaggaacatgatttgtccaaagagaaggcaaagaacggcatccaccaatcagtgggtgtaaaaacagtcctgagtttccagaagtatcaggtggacccattaggcaaagaaatttgcctctgtaaggttgagaaacatcccgagctcaattctaagaagaaaaagtga

SEQ ID NO: 2696 - RNA, 3237 nt, synthetic construct
  misc_feature 1..3237: note = Cas9 variant
  source 1..3237: mol_type = other RNA
atgggctacctgatcgggctcgacattggaataaccagcgtgggttatgccgtccttcagacagatttcaagggcaacccctacaaaatcctgttgatgaatactgttatttttcctgtggctgaggcaccaaagacgggggaatccttagccgcgccggtaagacagaaaaggtcttcacggcgcaccaaccgacgtacaaagttcagaaaactgagggtgcaaaagctatttgtccggttcggactcctggagagtgctgacgtggccacttttcttaatcagaaggttccccaccaggatatctggcaactgcgcaaagacgcattgaacagaaagctcagcaatagggaactgttcgagattctgtatttcttcgtgggccatcggggttttaaatccaaccgccgatctgaagtcaccgggaagcagcctaaagataatcaggtggtactcacatcgatccacgacagaggaaacaccttaaatgatttcgactcactgggcgagatgatgcaggagcttccagaatttaagactataaagcataacaaagcctacaggcccgataatacaatctatcctttgcgggcttggattgagcacgaactgagcgcaatcttcagtgttcaacagaagaacaatcgtcagattaccgacaactttatcacgcagtacctagatatattccgctcccaaagagacttcgatcagggcccagccgctccctctaggtttgggggaaatatgattgagcggatggtgggtcctgacagcctcgacgcccatgagaaacgagcggcaaagctgactaacaccttctttcgcttcaactttctttccacactgaataacttgaaaatccagctcactctgggcgccgaatttcacccattaaccacaccgcaaagagagattgtcctgcaggctgccaccctcaagtcacttaattataaacagatcaggcacaagctgcagttgcccgatagtgcacggtttaacctagtgccttaccaaagcaatgaagacccaatcaagacggagtctaaacattacctgttcaagcgcaaagctctcactcagattgaagccgtgacagataacccccagctgatagacaagatcgggaccattcttgcgtattttaaaggagataagactagacaggagaagctgtccgccttgaatctctcaagggcagagatcaaacaactgttacctataaaccagccaggcttcggtaatctgagcctaaagacaatgcacaaaattctcccctacctggaacaggggcatctttatcacgaggctgcccagttggctggatacgactttcaaaacaatctggtcgatcgtcagtatctccgggacaacctgaagaatccggttgtgaaccgagccatcggcaaaaccatcaaggtagtgaatgcaattatcaagaaatacggcgatcctgacgccattcacatagaacttacgagagagatcaagcatagtcacgaagagaggcagaaaattgctcgccagatgaacaccaacatggatcaaaatgacaaggtcgcggagcatctgcgggaaaacgggatccccgtgaatggacagaacatcattaaatctaagttgttctatgagcagaagggtatagacctctactccggccaacagatcaatgaacaggatctgtacacagaggaccactatcaggttgatcatattatcccatacagcatttcgtttaacgactctttcactaataaaaccgtgacaagaacttccaacaatcaaaacaaggcaaataggttacctctggaatatctatcagaggagaaacaggatgccttccgcgctcgagtcatgagtaacatcagcaattaccggaagcgtcagaacctcctgaaagaagggataaccgaggacaatagacagcaatggaagacaaggaacatcaacgataccggatatattaatcgccttttgtcccagtacctgcggaacaatgtgcagtttactaaaaagtctcacaaccccgtattcacggttaatggcgccacaaccgcatatatcagaaagaggtacggtattatcaaaaaccgacaggccactgacctccaccatgctgtggatgccgtcataattgggtgcatcagcaatacctttgtgtcacgcctggcaaagtacagtgaagcgcaagaggctcggtatcacaaacagttatggcagattacacaatacagacaggagcataaggacctgtccaccatcgaatatcaggagcttataaaacagttcccattgccctggcctgattttaggcacgaactcatggcccgtctgagcactgacccagcaaagatgatggcccaccatacatgggagcactacacggatgaagagatctctcaactaaagccggctttcgtcattcgctcagccaaccataaagtgaccggcagtgcacacgacgacactatctatagcaagaaactgtacgatcagcggggagttggcctcctgagaacatcccttcagaatttgaagtatgactctaaaaaggatgggattaagaactacgagaggctgaaagacggatcgaatagcttagtgtacgattccctcctgcgagctcttaaggaacatgacggtaacgccaaaaaggcgtttcccgataatcagctgttgatctcaaccggcaaccaccaacagataattacacacgtaaaaactgtcaagaagatcacccatcctatcgaggtgaatcgggacacggccattgctatcgggggacgcatgattagagttgatatattcaaacaggcaaaggcccagaaactcatcggcattccagtgtatgtcaacgacaccgtgaagcccacactgcctaacagggcttgtaccagtggtaaacggtactctgattggtatcaactaactcgacaggaccagtttctgtgcagcctcgtatccaatgatctggtgcttgttgaaacagcctcaccattgaaggtcactaacaatatcaccaacgaggaagtgcagacgacacaactgttatgttacttcagctcttttaatattgcaaacgcgcagatcaatttccactccataaacaatgacagtagcatcaaccccattgtgctcaataaagtcacctatctgactaagtaccagcttgactatctggggaactactttccggttaagcatgagtctagaaaaacattcaatcgcaagaggtga

SEQ ID NO: 2697 - RNA, 3237 nt, synthetic construct
  misc_feature 1..3237: note = Cas9 variant
  source 1..3237: mol_type = other RNA
atgcacaccagactggccctcgacatcggcacaactagcattgggtggatactttacgagctggtgaacggacagcccgcttccatcttggatggtggcacgaggattttctctgacgggcgggaagcaaagaccggacattcattagccgtcggccgccgaacagcgcgtggtatgagaaggcggcgcgatagatatctgaggcggcgcgctgccctaatgaaacgactcgcagccatcgggctgatgcctgagagtccagaagctgcagcccaacttgctactctggacccgtacgagttgagagccaggggactcgatcaccccctgcctccagaacatctgggccgggcgctctttcacttaaatcagcgtcgcggcttcaagagcaacagaaggaccgacaaagggaataacgagggaggtatgattgcagatgcctccgctcggctggagcaggccatgatggcagctggcgcccgatcttatggggaatttcttcataagcgcagagcggaggccacagcacccagggctacccctgccgttcggactcgcatcaatccacacttgacaggagaagacggcaaagagcagcccggttacgatttctatcctgacagaaagcacctggaggatgaatttcataggctatgggaggctcaagcccgtcacaacccagacctcaccccggcaatgggggatctgcttttccagacgatatttcatcagcggcccctgaaggcccctgctgtgggacgatgcttgttcctcgacgaaccaagactgcccaaagcgcaccctttaactcagcaaaggaccctgtacgagacagtaaatatgctccgcatcgcaccacccggccagccgaagcggagactttcgagggtgcagcgcgaccagattgtccacgccctgaacaatcgaaaaatcttggcttcacctggcaagaacgtgctaactctggccgcaattgggaaactcctgaagctgcggcccggagaagcctttagcctggataccgctaatcgtgacgccatcgcatgtgatccagttagaatgagtttggcgtatgagggtaggttcggccctcaatggtccgctctctctgtggagagccagtgggaactgatacagcgcttacgggacgatcaagacggggccgcactggtcgattggattatggacagatacggatttgatagggaccgagcccgcgctatcgccgatgcacccctaccagagggcttcggtcggctcggggaaacagctaccagagccgtgctggcggtacttattggcggaacgactgagcaggaagttttgacatactccgaggccgtggctgcatgcggctgggaccattcaaggctggggaccggagaggtcctcgaccgtctgccctattacggtcaggtgcttgatcgccacgtgctgcctggcactgggcggccagaagacgatgagatcacaagatttggaaggatcaccaacccgacggtccatattggcttgggtcaggttaagcgactcgtgaataaagtaatagacgcctgggggcggccccacgaaatggtggtcgagctggctcgcgatttaaagatgagtgaagaccaaaaacgcaacctggccaaggtgaatgcacagaaccagagggcggccgagatgcggagcgctaaactaatcggcgatctcaagattgaggacaacggacgaaatagaggcatcctgcgcgtttgggaagagtctgccgcagatgtgcttcataggtgttgcccttataccggggctcagatatccgcctcaatgttgttcgacggaagctgtgatattgaccacatcctgccatacagtcgtacactcgatgacggtttcaacaatcgggtcatctgcctgaaatctgcaaacagagaaaagaggaatttaactccctgggaggcctggggcaacacccctaagtgggctgcgattgaggccaatctgaaaaaccttccacccgcaaaggcttggcgctttgccccggacgccatgttgcgatatgaaggggagagagatttcacagctcgggcactcgtggacactcaatacctgtccaggctagcccgcgaatatctggagtgtctctacgcggaagatatcgaccctggaccacacagcggcaaaaagccccgtagacctatttgggtagttaccggtaaactgacagagcttttgcggaggcattgggggcttaattcgttactccccgatgctcaccgcggcaccgccaaggcaaagaaccgactggaccatagacaccacatgatagatgccgctgtggtcggagcaactgaccatgccacggtgcagcggatcgcgaatatggctaaaggcaacgtcgagaatgggcttgaagatctggccggaacaattttgccaccttggcccggcctcagggacgatctgaaggcacgcctagagagaaccatcgtgtctcacaggggtaaccatggggccatcgacccagctgcccggaaacagggacgtgatactacctccggccagctgcacaatgacacagcatacggtctcaccggcgaaactctgaagggggttccgcttgtggtaaaccgcaaacctattgacatgttgacacccgctatgatagataagatccgagacccacatctgtcaagatggttaacggccgtcaccaagggaaaagagggcaaggattttaaagcggccgtggaagcattcagggctcaccccgggccttatcggggaattagaagagttaggctcatcgagccagtggaggtcattcggatcaaggaccgaaacggcagaccctacaaaggttataagggggatagtaatcaatgctacgaagtgtggtgtctgcctgaccgcactcttacacaccatgtagtgagcacctttgccgctcaccagggacagacaggcaagccgcatccagcagccaaaaggctggcccggctatataagggtgatatggttcgtctcgacagatccaaattcggctctgtcatagctactgtggagaagtttgataggaacgggcagctggaattggtgccccacaatgagggaaacgcggaccaacgctaccggaaagataagagcgactcagtcttcatccgactgagagcagccacctttattgctagtggcgccaggcgcgttatcgtggacgaaatggggcggattagagatcctggaccaggcaaacattga

SEQ ID NO: 2698 - RNA, 3240 nt, synthetic construct
  misc_feature 1..3240: note = Cas9 variant
  source 1..3240: mol_type = other RNA
atgaagtacggcatcgggctggactgcggaattaacagcgtgggttattgtataatggagctcaattccgatgacgaacccaaaagaatcgtcaggcttaactctcggattttcaccgaggccgaaaatcctaaggatggctcaagtctggctgcaccacgccgagaggcccgtgggttgagaaggcggatccgcagacacaaacataggttagaacggattcgcgcgctgctagttcgagagaacatcgtgacacaggctgagctcgacaatatgtttagcggaactctgtccgatatatacgaacttagaacggccgcactggacgccccgttgaacaatatcgagttcgctagggtactcattaacctggcacaacggcgtggctttaagtctaatcgcaaatcggaaaagtcaagcagtgataaggagaccggtaaactgctctccgccatcaagaaaaacaaggagtctattgaagctgggggatatagaacagtgggcgagatgttattcaaagacgaaaggtacgccaagcacaagcggaataaaggcgaggcgtatctgaacactgtcagccgagatatgatcgaagcagagatacatgccgtgtttgcttcccagcgcaatttcgggatgccctttgccaacgagaagattgaaaatgagtacaccgacatcgcactttcacagagacctttcgatttgggaccaggtgaaggccccgagaactgcaaaagtccttatgctgggaagcagattaaaaacatgatcggacaatgtacatttttcccagaagagaagagggccgttaaagcgagctactcttttcagctgttctccctactccagggcatcaataacattaccctggtgtcaagcgacggtaatacttttccccttagtcaggagcaacggaagacactgaaggattactgcttcaaaaccgccaacgtcacgtatgcatctatacgcaaggtgttgcagatccctcaggaatacactttcaaaaatattacctatacagacgacgggatcgagaagtccgagaaaaagactaagtttcagcacctcaaaccataccatgagatgaagaaagtactgggaagcgctatacaaaccttaacaccggaagaactggatgagattggcgaaatcttcaccttttataaggacgagacgatcattatcaaacagctcgaagagactgagattgataagtcgctttacgacctgttgctacagctgcccacattcgaaaaggccggccacatatctaccaaggcttgtaaaatgatcattccttttctcgaggaagggaaaacttatgataaggcctgcgagtgtgcaggactgaacttcaaagcccacacaaatatgcaaaagcagatgcttctgccagctaagtccgacgaattgaacgatgttgtgaatcccgtcgtgagaagggcgatctcacagaccatcaaagtggtcaacgcaattatacgtgagatgggtacgagtcctacctacatcaatattgagctcgcccgggaactgagcaagtccaaaaaggagcgagacgaaatcaacaaaaagtacaaattaaatcaggctgagaacgaaagactgaagaatgagattatcgataactttaagataaaaccaaacggccaagacatcattaagctaaaactctggcatgagcaggatgacgggatctgcccctatacaggagttaggattaagtacgaaaatctgttcgacgatggctatgccgagatcgaccacataattccgtactctcttagctttgatgactcattcaacaataaaatcttgactaccgcaacacagaaccgccagaagggtaatcggattcctctggaatatctccccgagagtgaaaaggatgggtttagagtgtgggtaaactccaatatcaggaaccatcgcaaacgacaaaatctgcttaaggagcacttcactgaggccgacaaaaaggaatttaaaagccggaacctgaatgatacccgttacttgaacaagctcctgttaaattatataaacgacaatctgctattcacagatttctacaacggcaagaaaaagcacgtgacctctgtcaacggagctgtgactgcctacatcagaaaaaggtggggcattaataagaaccgcgaggacggggatctccatcacgcagttgacgcggctgtgatcgcctgtgtcacgcagggaattatcaatcggataacagcatattcagccagaaacgaagctccatacgatctgaataccgagactggtgagattaaagaaaggtttcctcttccctatccaaacttcaagaaggagttggacgcccgaaccacaatcgaagacgagaaacgcctgaagcgggtgctcatgagttttagcaattactcctatgatgacgtagaaaaagcaaagccctgcttcgtttctagaacccctcataggaaagtgactggcgctgcccacgaggagacaatccgttcggggaaggtcgaaggatttacggtgagcaaaaccgagctgactaagttaaagctgacaaacggcgaaattgagggttactatgaaccagagtccgatacccttttgtacaatgcgctcctgcagcgcctaaacgagttcgggggcgacgccaaagctgcatttgccgatgagttccataagccgaaagctgacggaacacccggccctgtcgtgaagaaagttaagactatcaagcggtcaagttctaatgtgaaagccagaaacaagaatgggctgggagtagcagataacggtagcatgattaggatagacgtcttttacgtggaaaatgaaggctattacttcgttccaatctatgtggcggataccgtcaaagagatgcccaacgaagcctgtccttttgggaaggacaaaaagaagattatgacggatgacgatttcctcttttccctgtacccaaacgaccttatcaaaattaccgctaagaaagacatgaagttctcattggccaataaagagagcggactgcccaagaacaagtatgcaaatgaggtgttagtatactattctgctgccgatatctccaacgcaagtataagcgtgatcatgcacgacaatgcctacaaattccgaggctgcggtattaagtctctcgttaaactggaaaagtacacagtcgatccgcttgggaacgtgtccaaagtgaatcgggagaagcgcatgtattttaagtga

SEQ ID NO: 2699 - RNA, 3240 nt, synthetic construct
  misc_feature 1..3240: note = Cas9 variant
  source 1..3240: mol_type = other RNA
atgagactgggcctcgacatcgggaccagctccattggatggtggctttacgagacagatggtgccggctctgacgctaggataactggggtggtcgatggaggcgttcggatcttctcagacggtcgcgatcccaagagtggggcaagcctggccgtggaccgacgtgcggctagagccatgaggcggcgcagagataggtatttgcggcgccgagcaacgttaatgaaagtactggccgaaaccggactaatgcctgctgacccagcagaggccaaggctctcgaagccctggatccgtttgcgcttagagcagccggcctggacgagcccttgcctctcccacacctgggcagggctctgttccatctcaaccagcggcgtgggtttaaatccaatcgcaagacagatagaggagacaacgaatctggtaaaattaaggatgccactgcaaggttagacatggagatgatggctaatggcgcccggacctacggggagttcctgcacaagcgacgccaaaaagcgacagaccccagacatgtgccttcggtcaggacccggctttcaatcgccaaccgcggaggcccagatggtaaggaagaggcagggtatgacttttaccccgatagaaggcacttggaagaggagttccataaactgtgggctgcccagggagctcaccaccctgaactaactgagacactccgtgacctgctttttgaaaagattttctttcagcggccactgaaagagccggaagtgggcttgtgcctcttcagcggccatcacggggttccccctaaggatccacgactgcccaaggcccatcctttaacccagagaagggtgctgtatgagacggtcaatcaactccgcgtgactgcagacggacgggaggccagaccacttaccagggaggaacgcgatcaggtaatccacgctctggacaacaaaaagcccacaaaaagtttgtcctctatggttctaaagctgccggcgctcgcaaaagtgctgaagctgcgagatggtgaacggtttactctggagaccggcgtccgtgacgccatagcttgtgatcctttgagagccagccccgcacacccagacaggttcgggcctcgctggtccatcctcgacgccgatgctcagtgggaagtgatttcacggatcagaagggtgcagagtgacgccgagcatgcagcgctggtcgattggttaacagaggctcacggactggaccgagcccatgcagaagccaccgctcacgcacccctaccagatggctacggtcgcctcgggctgacggccactacacggattctttatcaattgaccgctgacgttgtgacttacgccgatgcggtaaaagcctgcggctggcatcacagcgacggaagaacaggcgagtgttttgataggctgccctactatggggaagtgctcgagcgtcacgtcatccctggatcttaccatccagacgatgacgatataacccgcttcggtcggattacgaatccgaccgtgcacatcggcctgaaccagcttagaaggctggttaatcgaattatcgaaacacatgggaagccccaccagatcgtggtcgagttggctcgggacctcaagaaatccgaggaacagaagcgcgcagacattaaaagaataagggatactaccgaggccgctaagaaacggtcagaaaagctggaggagttagaaatcgaggacaacggacgaaatagaatgctgctacgcctctgggaagatctgaaccctgacgatgccatgaggcgtttctgcccatatacaggcactcggattagcgcagcgatgatctttgacggtagttgtgatgtggaccacatacttccctactctagaaccttggatgactccttccctaataggacactgtgcctccgcgaggccaaccgacaaaagagaaatcagaccccatggcaggcttggggcgatactccccattggcacgccattgcagctaacctgaaaaacttaccggaaaataagcggtggaggtttgcccctgacgcaatgacgcgcttcgagggggagaacggatttctggatcgtgcccttaaagacacacaatatttggctagaatcagccggtcgtacctcgacaccctgttcactaagggcgggcatgtatgggttgtgccaggaaggtttaccgaaatgctacgccgacactggggtcttaattctctcctgtccgatgcgggcagaggggccgtcaaagcaaagaaccggacagaccataggcaccacgctatcgatgccgccgtgattgctgcaaccgaccccggacttttgaatcgcatctcaagagccgcgggccagggtgaggctgccgggcagagtgcagaactgattgccagggatactcctcccccatgggagggcttccgggacgatttacgtgtccgcctcgaccgaataatcgtgagccatagagctgatcacggaaggattgaccatgcagcccggaagcagggccgcgattccacagcggggcaactgcaccaggaaacggcttattctatcgttgacgacatccatgtggccagcagaaccgatcttctgtcattgaaacctgcacagctcctggacgagcccggaaggagtggccaggtacgggatccacaactacgaaaggccctgagagtcgctactggtgggaaaacaggaaaggactttgagaacgccctccgctacttcgcatccaaaccgggcccttaccaggctattaggcgggtgcgtataatcaagcccctgcaggcccaggcgagagttccagtgcccgcccaagatcctattaaggcatatcagggtggcagcaatcacctttttgaaatctggaggttgccagacggggagattgaagctcaggtcatcacctctttcgaggcccacacactggaaggagagaaacgcccccatcctgctgcaaagcggttactccgagtgcacaaaggcgatatggtagccctggagagagacgggaggcgcgtggttggacatgtccagaagatggatatagccaacggcctttttatcgtgccgcacaatgaagctaacgcggacactcggaataacgataaatcagacccattcaagtggattcaaatcggtgcaagacccgccattgctagtgggatccgtagggtgagcgtcgatgagataggacggctgcgcgacggcggtacccgacctatttga

SEQ ID NO: 2700 - RNA, 3240 nt, synthetic construct
  misc_feature 1..3240: note = Cas9 variant
  source 1..3240: mol_type = other RNA
atggacgaggaagccaagatccagctgagcaaagagtcctacgaagaggaactcgagtctcttctggagaagtcaggcgaagagttcagagatgtgtttttgcaagctaaaaaggtctatgacgcaattttactgagtgatatactaagcaccaaaaagcagaactccaaggccaaactctctctggggatgatcgaaaggtacgactcgcacaagaaagatcttgaggagctgaagcagttcgttaaagcgaatttgcccgaaaagacagctattttcttcaaggactcaagcaaaaacggatatgccggttacatcgatggcaagactacgcaggaggacttttataaattcctcaagaaagaactgaatgggattgcaggaagtgagcggtttatggaaaaggtggatcaagagaacttcctgctcaaacagcgcaccacagccaatggcgtaatccctcatcaggtgcacttaactgagctgaaggctataatcgaacgacagaagccatactatccgtttcttgaggaagcacgtgacaaaatgattagattgctgaccttcaggatcccctactacgtcggtcctctagcccaaggggaggaaacatcctcttttgcttggctcgagcggaagaccccagagaaagtgactccctggaacgccacagaagttattgattatagcgcgtccgcaatgaagttcatccagcgcatgataaattacgacacctatctgcctacggagaaagtgcttccaaagcattcaattctgtaccagaagtatactatctttaacgaattgaccaaagtcgcctacaaggatgagagaggaattaaacaccagttcagtagcaaggaaaagagggagatcttcaaggagctctttcaaaagcagcggaaagtgacagtaaagaaactgcagcaattcttatctgctaattataacatcgaagacgccgagattctgggcgttgacaaggcatttaattcctcatacgctacttaccatgatttcctcgaccttgccaaacccaacaccgaacgcgtggcggagctgttggagcagcctgaaatgaatgccatgtttgaggatatagtcaagatcctaacaattttcgaagaccgagagatgatcagaacccagctgaagaaatatcagagcgtgctcggcgatgggtttttcaagaaactggtgaagaaacactacacgggatggggtaggcttagtgaacggctgataaacggcattcgtgacaagaaaactaataagacaatcttggattatctcatcgacgatgacgattttccatacaaccgcaacagaaatttcatgcaactgattaacgacgactctttatcctttaaggaggagctggcaaatgaactagctctcgccgggaaccagagcctgcttgaggtcgttgaggctttgccgggatcgcccgccatcaaaaagggcatttggcagaccctgaaaatagtggaagaactcatcgagattatcggttataatcctaagaacatcgtagtggagatggcaagggaaaatcagcggactaaccgatctaaaccacgcctgaaggcccttgaggaagctctgaagtccttcgattcacccttgctcaaagagcaacctgtcgacaatcaggcgctgcagaaggatagattatacctgtattacctacagaacgggaaagacatgtacacaggagaagcactcgatattgacaggctgagtgagtatgatatagaccacatcattccacggagctttatcgtggataattccattgacaacaaggttcttgtgtctagcaaagagaatcgcttgaagatggatgacgtccccgatcaaaaggtggtaatcagaatgaggcgttactgggaaaaactgctccgggccaacctgatatcagagcgaaagttcgcttatttaaccaaactggaacttacgccggaggacaaggccagattcatccagaggcagttggttgagacccgccagattacaaaacatgtggcagccatcctcgaccaatactttaatcagcctgaagagagtaagaacaagggcattcggatcataactctgaaatccagcctagtctctcagttcagaaagacctttggcattcacaaagtgagggaaatcaacaatcatcaccacgctcatgatgcctatctgaacggggtcgtggcaattgcgctcctgaagaaataccccaaacttgagccagaatttgtttatggaaattacacaaaatttaacttggctactgagaataaggccaccgcaaagaaagagttctactcaaacatcctgcgctttttcgaaaaggaggaatatagttacgacgagaatggtgaaatattttgggataaagcccgacacatccctcaaattaagaaagtgatcagctcccatcaggtaaacattgtcaagaaggtggaggttcagacaggcgggttctataaagagaccgtgaatcccaagggaaaaccagacaagttaatccagcggaaagctggctgggatgtctctaagtacggtgggtttggctcgcccgtggtagcctatgcagtggctttcatatacgaaaagggaaaagcccgtaagaaagcgaaggccattgagggcatcactatcatgaaacaaagcctctttgaacaggaccctattgggttcctgtccaacaagggatattcaaatgttacgaagttcatcaaacttagtaagtacacactgtacgagttggaaaacggtagaaggcgcatggtcgcttctcacaaagaggcacagaaggccaatagctttattctcccagagaaactggtgaccctactgttctatgctcagcattacgatgaaatagcccacaaggagtcctttgactatgtgaacgatcacctctcagagttccgggaaatcctggaccaagtcattgattttagcaatagatacactatcgcagcgaagaacaccgagaaaattgccgaacttttcgagcagaaccaggaatctacagttcagtccttgagtcagagctttatcaatctgatgcaattaaacgctatgggcgccccggcagacttcaagtttttcgatgtgataatccccaggaaacgatatccttctctcaccgagatttgggaatccactatcatttaccagtcaatcacagggctgcgcgagacgcggaccagaatggctactctttgggacggagagcaatga

SEQ ID NO: 2701 - RNA, 3240 nt, synthetic construct
  misc_feature 1..3240: note = Cas9 variant
  source 1..3240: mol_type = other RNA
atggacgaggaagccaagatccagctgagcaaagagtcctacgaagaggaactcgagtctcttctggagaagtcaggcgaagagttcagagatgtgtttttgcaagctaaaaaggtctatgacgcaattttactgagtgatatactaagcaccaaaaagcagaactccaaggccaaactctctctggggatgatcgaaaggtacgactcgcacaagaaagatcttgaggagctgaagcagttcgttaaagcgaatttgcccgaaaagacagctatctttttcaaggactcaagcaaaaacggatatgccggttacattgatggcaagactacgcaggaggacttttataaattcctcaagaaagaactgaatgggattgcaggaagtgagcggtttatggaaaaggtggatcaagagaacttcctgctcaaacagcgcaccacagccaatggcgtaatccctcatcaggtgcacttaactgagctgaaggctataatcgaacgacagaagccatactatccgtcccttgaggaagcacgtgacaaaatgattagattgctgacctttaggatcccctactacgtcggtcctctagcccaaggggaggaaacatctagcttcgcttggctcgagcggaagaccccagagaaagtgactccctggaacgccacagaagttattgattattccgcgtcagcaatgaagtttatccagcgcatgataaattacgacacctatctgcctacggagaaagtgcttccaaagcatagtattctgtaccagaagtatactatcttcaacgaattgaccaaagtcgcctacaaggatgagagaggaattaaacaccagtttagctctaaggagaaaagggagatcttcaaggaactcttccaaaagcagcggaaagtgacagtaaagaaactgcagcaatttttatccgctaattataacatcgaagacgccgagattctgggcgttgacaaggcattcaattcaagctacgctacttaccatgattttctcgaccttgccaaacccaacaccgaacgcgtggcggagctgttggagcagcctgaaatgaatgccatgttcgaggatatagtcaagatcctaacaatttttgaagaccgagagatgatcagaacccagctgaagaaatatcagagtgtgctcggcgatgggttctttaagaaactggtgaagaaacactacacgggatggggtaggctttctgaacggctgataaacggcattcgtgacaagaaaactaataagacaatcttggattatctcatcgacgatgacgatttcccatacaaccgcaacagaaattttatgcaactgattaacgacgactccttatcgttcaaggaggagctggcaaatgaactagctctcgccgggaaccagagcctgcttgaggtcgttgaagctctactgggatctccggccatcaaaaagggcatttggcagaccctcaaaatagtggaggaactgatcgagattatcggttataatcccaagaacatcgtagtggagatggcaagggaaaatcagcggactaaccgatccaaacctcgccttaaggccctggaggaggctttgaagtcatttgatagtccactcctgaaagaacaacccgtcgacaatcaggcgttacagaaggatagactgtacctatattacctccagaacgggaaagacatgtacacaggagaagcactggatattgacaggcttagcgagtatgatatagaccacatcattcctcggtccttcatcgtggataattctattgacaacaaggttttggtgagctcaaaagagaatcgcctgaagatggatgacgtcccagatcaaaaggtggtaatcagaatgaggcgttactgggaaaaactcctgcgggccaacttaataagtgagcgaaagtttgcttatctgaccaaacttgaattgacgcccgaggacaaggccagattcatccagaggcagctcgttgagacccgccagattacaaaacatgtggcagccatcctggaccaatacttcaatcagccggaagagtccaagaacaagggcattcggatcataactctaaaaagctctctggtctcacagtttagaaagaccttcggcattaacaaagtgagggaaatcaataaccaccatcacgctcacgatgcctatctcaatggggtcgtggcaattgcgctgcttaagaaataccctaagttggagcccgaatttgtttatggaaactacacaaaattcaatctggctactgagaacaaggccaccgcaaagaaagagttttacagtaatatcttacgcttctttgaaaaggaggaatatagctacgacgagaacggtgaaatattctgggataaagcccgacatatcccacaaattaagaaagtgatctcctctcaccaggtaaatattgtcaagaaggtggaggttcagacaggcgggttttataaagagaccgtgaaccctaagggaaaacccgacaagctcatccagcggaaagctggctgggatgtctcgaagtacggtgggttcggcagcccagtggtagcctatgcagtggcttttatatacgaaaagggaaaagcccgtaagaaagcgaaggccattgagggcatcactatcatgaaacaatccctgttcgaacaggaccccattgggtttctttcaaataagggatatagtaacgttacgaagttcatcaaactgtctaagtacacattgtacgagctcgaaaatggtagaaggcgcatggtcgctagccataaagaggcacagaaggccaactccttcattctgcctgagaaattggtgaccctgctctatcacgctcagcattacgatgaaatagcccacaaggagtcatttgactatgtgaatgatcacctgagcgagttccgggaaatccttgaccaagtcattgatttttctaacagatacactatcgcagcgaagaacaccgagaaaattgccgaattgttcgagcagaatcaggaatccacagttcagagtctgagccaatcttttatcaacttaatgcagctcaatgctatgggcgccccagcagacttcaagtttttcgatgtgataatcccgaggaaacgatatccctccctgaccgagatttgggaatcaactatcatttaccagagtatcacagggcttcgcgagacgcggaccagaatggctactctgtgggacggagagcaatga

SEQ ID NO: 2702 - RNA, 3243 nt, synthetic construct
  misc_feature 1..3243: note = Cas9 variant
  source 1..3243: mol_type = other RNA
atgaagaccagcttcgcctttgacatcggcacaaactccattgggtggtgcgtgctggctctcgataatgcaaaccttccctacagaatactggacgccggagtcaggatcttctctgatggtcgggagcctaaatcaggcacgagtttggcggaagggcgccgattagctcgtggaatgagcagaaggcgggaccgctataagagaaggcggaaagccgttattcgcactctgatcgagtacggcctaatgccagatgacccggcagcccggagagctctcgtggcagaaaccaatgataaggcccccggtaaaattgcttccgacgtatatgccctgagggcgcgggcacttgatgacaagctgcctttgcaccatatcgggcgtgccctctttcacataaaccagcgcagaggattcaagtctaataggaaaacagataagcgggacaacgatcaaggcaaaatcgcttcgggcatttcacgactgcgcgacaagctggccagcgaggggatgagaactctcggagaatacttaaatcataggcaccaggcaggtaactgggtgcgggtccgcccaagtagagtgcccggcaaagacgataaggaggaggacgggtatggattttaccctgaaagggctctgcttcaggatgagttcaatgccatctggaccgcgcaggccgcacattatccagacgttttgacagaagaacgtcggacccacctggagactattatctttttccaacgacccctaaagcctgtgcaggtcggcaaatgttcctttaacccaggtgaagagagactcccgagggctcaccccctgttccaggaatttcgcctttacaaggaggtgaatgaactggagttggtagatcggaaccaggaccatcacaaactctctctggatcaaagagacgccttaatagctcagctgaagacacagagggaggccgcatacagcgccctccgcaaaaccgctcgagcgcctcttgggacgcggttcaataaggaaactgagtcccgtaccaaaatgaagggagatgaagttgcagccgagctgtcagctaagacaagatttggccaggcctggattagtatgccattggaagagaggtggatcattgtggacactctacgccgggtcgaggatcccctggaactcaccgcatggctggagcaacattatggccttgacggggaacacatcgacgccatcctggctgccagattgcctgagggatacggtaggctcggcgaaacagcactgaccgagattttagtggagctgaaagcggctgtgataagcgaagccgaggcagcccgacgcgctgggtatgatcacgccctactccagcggggagcaggcctggaagcccttccaaagtaccaggaggtcatcgctagaaggattcccccgggtacggggaaccctgacgatccctatgacgttgagaaaggccgtatcactaatccaacagtgcatataggattgaaccaactgcagaaggtactcaacgcgctgattcgccggtacggcaaacctgaacagatcgccatcgagcttgctagagaactgaagttgaatgatgagcagaagagggagaaaaacattgagatcgcacgaaatacccgggccgctgagcaacgctctgccaagctcgtggaactgggggtccccgacactggatataacagagtgttactgaaactatgggaggaactcaatctgagggcaccagagaaccgggtttgcatttactgtggtgaacccataaatatcgagacacttttctcctcagcggtggatattgaccacatcttgccttggagcaagaccctggatgacagtcaggccaaccgactcgtctgccatgtggcttgtaatagacagaaagccaactacgcaccagctgaggtaccgcagtggcaaggccgctatgatgacatcctggccagggcaaatacgttacccctgaacaagcgttggcggttcgggagagatgccatgaagaaatttgctgacgaagagaccttccttgcgaggcagttgacagacactcagtacctctctcgcctggcccacgcatatatggctgccctataccctgatgaggaaccagacgcccagggagttctggctcgaaagaatcatgtgagagtcattaccggccggatgacagaaatgctcaggcgccaatggggtctgaactcccttttggcagatcacaatcagaaaaaccgtaacgaccacagacatcacgccatagatgcggctgtggtcggggtgactacccgggccctgttacagaggatcgcaacagttgccggcggacgcgaggctcaggcactcgaggaaaccattggcaagatcgagcccccttggccagggtttcgagacgaactgcaagccgtgattaaaagaatcgtagtcagccataagcccgatcacggaactcttccgaagcctggtcagggcgggcagacggcgggacaactgcacaatgacacagcttatggcttgaccggtgagactgattcgcgggggaccccaatagtggttaggcgcaaacccttcacatctctcaccgagaaggacctgccttccatcagagataggcagctagcccaggcactgggctcagccattgctggacggagtggcaaagaactccaggccgcactggagcaatttcgtgaccgcgatgactacaagagcatccgacatgtgagagtcgtggaaccccttaacgtaattccaatcagggacgggactggacgggcttataaagcctacaagggcgatgcgaattaccgctatgacgtgtgggagttgcctaacggtaaatggatgcacgaagttgtctccatgttcgatgcccatgacagatcttggacaagcgcagtgcacatacatcaccccgctgccaggcgggtgctgtcattaaagcagaatgatatggtcgcttacgaccacccacaggatgggccgacgattggacgagttgtgaagtttagtcagtccggccaaatgaccttcgcacctcataaagaggccggtgccctcaaggctagagacgcggatcccgaggaccgctttaggtatttctacaaaagcggctctgcaatgaaggatatcgggctgcgacaggtgcgtgtagacgaaattggaagagtctttgacccaggccccagggataaagaggcccgcaacgctcggaagaagaaatcaactgactga

SEQ ID NO: 2703 - RNA, 3243 nt, synthetic construct
  misc_feature 1..3243: note = Cas9 variant
  source 1..3243: mol_type = other RNA
atggccaagagcttcgcttttgacatgggcaccaactccatcgggtgggcagtgctgggactcgattctgccggtgaccccgattcaattgagggcgcgggggtcagaatattcagtgacggaagggaacctaaaagcggcgcttcccttgccgagggtcggcgcatcgcacgagggatgtctcgtagaagggaacggtacaaggcccgcagaaaagctctgattaggacattgggagattatggcttaatgccactggagcgggcagcccgccgagctctagttgccgaaactaatgacagatcgtttggcctcgtggcgcaggatgtatacgcactgagggcccgggctcttgtggagaagctgccgccctatcacttggggcgtgccctcttccatctgaaccaacgcagaggatttaaatcaaataggaagacggacggtcgggataacgagctgggcatgatcgcaaccgggattgctgccctcgacgcgcagttaaatggacgaacactgggccagtaccttcacgaaatgcgcggtgccgatcctagacagagggggcaagtccgggtgcgcccacatttggagatcaacgacaagggaagagaaatagcagcttatggcttctacccccagagggccatgctggagcgtgagtttaatgctatctgggccgcacaggcccctcaccatccagaactactcagcgaggaacggcgagctcacctgttccaggttatcttttatcaaagaccccttaaacagcctgatccagggaggtgcagtttcaacccggcggagccccgcctggcaaaggcccaccctttgtttcagcggttcagactcgtgaaagaaattaatgagctgaggattgtcactgggtccaactctcagggagtgccattaaccctggagcaacgcgacatcctccttacactgttgcgagacaagaaagctagctcctttaagaccctactggccaagataattaaaggtcagcccgaagcacggttcaataaggcctcagatagtcgtgacaaaatgaagggcgatgagctcgctgccactatgagcgacaaaacaagattcgggcaggcatggtttgcgatgcctgaagctgagcaatggaggatcattgccaagctgcgcgatatcgacgatccacttgaactgaacgcatggttggagtctgagtacggactcgcccccgaacggagagacgctgtagccaatgcactgttaccgcagggctacggtaggctgggggagaccgctctacgaacgatgctcgattatctggaagccgcggttatctccgaggccgaagctgcagcccaggctggctacgaccatgcccttgcacgccggggagcgggcttggatcagctgcctaaatatcaagaggtgctcgggagaaggattcccccaggatcaggtgagcctaacgacccctacgacatacgtatgggccgcatcagcaatccaactgtccacattgccctgaaccagcttcggagagtggtgaacgctctgatcaggaagtatgggaagcccgccgaaatagcaattgagttggctcgagatctcaaactgagtgaagaacagaagcgggaggtcaatgccaccatcgccaaaaacacacgcgacgcagaaagaagggctgttcggttagcggatgagggaatcgacaatactggccataaccgagccctgctaagattctgggaggagctcgcagctgatcctctggaccgcgtgtgtgtatactgcggtgggggcattggagccgcctctctttttaatggctccgtggatatcgaccacattttgccatggagcaggaccctggatgactcgcgtgctaaccggatactcgtccacaattcttgtaacagactgaagaggaatttcgcaccgtttgaagtgcccgagtggcgcgagatctatcaggatattttagttcgagccgcgaaactgcctgctaacaagtcctggagattcgccccagacgcaatggatcggtttgaaggggagaaggacttccttgccaggcaattgacagacacccagtacctcgctcgcatggcacatgaatacctggccgcgctatatcccgatgaggaacctgacgagtggggagtgtttgctcgtggtaatcacgtcagagtggtaccaggccggctgacggagatgctcaggcgcgcctgggggctgaacgcaatcctttcagatgacaatcgaaagaacagaaatgatcatcggcaccatgccatcgacgctgttgtggtcggagtgactacaagggatatgttgaacaaaattagtcaggccgcaggccgcggtgctgacatgggggccgcggatgccctgagaaggttcgatcccccgtggcctagctttcaccaggcagtccgggctgccgtggaacgtatattagtttcccaccgcgctgaccatggcaccctcccaggaactgacggccaagggtctacagcaggacagctgcacaacgataccgcctacggccttacgggtgagacccgaaaagggctggccgtggtagtcagaaggaagccctatttgagcctcgaacctcgggacatcgagacaattcgcgacccccagctgagagatcatctagctactgaaacctacggactggcgggcgcagagttcacagccgctctcaaaaggctgcagcaaactgacaagttttatgccggtatccggcgagtgagagttaccgaggcactttcagtgattccaatccgcgatgccacaggccacgcttacaaggcgtataaaggggacgccaatttcaggtacgatgtctgggaattgcctaacggaaagtgggtgcccgaggtaataagtatgttcgacgcacacgatcggggctgggtgtcccaggttcatgctgccaatccagcagcccgtagagtcctgagcttaaggcagaacgacatggtggcttaccaacacccggaacaggggctcgtgtatggacgcgtcgttaaatttggccagtctggtcagatgaccttcgccgcgcatcacgagggcggatcactgaagagtcgggatgcagaccgagatgacccttttaaatacttctataagagcgccggcactatgaaggacatcggtcttagacaaattagggtggatgagatcggccgcgtgcaggaccccgggccacaggatcgggactccaaaagagtacgtaagtctgataggtga

SEQ ID NO: 2704 - RNA, 3246 nt, synthetic construct
  misc_feature 1..3246: note = Cas9 variant
  source 1..3246: mol_type = other RNA
atggccgctttcaagcccaaccctatcaattacattctgggcctcgacatagggatcgcaagcgtgggatgggccatggtcgagattgatgaagacgagaacccaatctgccttattgatctgggtgttagagtgtttgaaagggcggaggtaccgaaaaccggcgactccttggctatggcccggcgcttagcacgatctgtgcgtagactgacaaggcggcgcgcccacagactactcagggctcggcgcctgcttaagcgagaaggggtcctgcaggcagccgatttcgacgagaatggattgatcaaatcactccccaacactccttggcaactgagagctgccgcgctggataggaagctcacgccattagagtggagtgcagtgctgcttcatttgataaaacaccggggctatctgagccagcgtaagaatgaaggtgagaccgccgacaaggaactaggggctctcctgaaaggagttgccgataacgcacatgcccttcagacaggcgactttcgcactcccgctaagctggcgttgaataaattcgagaaggagtccggccacatcagaaaccagaggggagattactctcataccttttcgcggaaagacctccaagccgaactgaatttactgttcgagaagcagaaggaatttggaaaccctcacatttcagatggtctcaaagagggcatcgaaacacttctgatgacccagcgaccagcattgagcggggacgctgtgcagaagatgctaggacactgtactttcgagcccacagagcctaaagccgctaagaatacctatacggccgaacgctttgtctggctgactaaactcaacaatctgagaattttagagcaaggcagtgaacagccactgaccgacacacagagggcaaagttgatggatgagccgtaccggaaatccaagctcacttatgcccaggctcgcaagctgttaggtctggaagacaccgcgttctttaaagggctaagatacggaaaggataacgcagaggcctctacactcatggagatgaaggcttatcatgccatcagcagggcactggaaaaagagggccttaaagacaagaagtcccccttgaatctgtcacctgaactccaagatgagataggcaccgccttcagtctgtttaaaacggacgaagatattactgggcgtcttaaggaccgggtgcagccagagatcctggaggctttgctcaaacacattagcttcgataagttcgtacagatctctctgaaagccttacgaagaatcgttcccctgatggaacaaggaaagaggtacaacgaggcatgcgcggaaatttacggtgaccattatggcaagaaaaacacagaggagaagatatacctacctccaatccccgctgatgaaattcgcaatccggtggtcctccgggccctgtcccaggcaagaaaagtgatcaacggggtggtcaggcgctatggaagccctgcccgaatacacattgagaccgctcgggaagttggcaagtcatttaaagaccgtaaggagatcgaaaagagacaggaggagaataggaaagaccgcgaaaaggccgcagctaaattccaggagtactttcccaacttcgtgggtgaaccaaagagtaaagatatccttaagttgcggctgtatgagcaacagcacgggaaatgtctctactctggcaaggaaattaatctgggaagattaaacgagaagggctatgtagagatcgaccatgccctgcctttttccaggacttgggatgacagcttcaataacaaagtgcttgtcttggggtcggaaaatcagaacaagggaaatcagacaccctacgagtactttaacggtaaagataattctcgagaatggcaagagttcaaggcgcgcgtggaaacctcccggtttccaagaagtaaaaagcagaggattctcctgcagaagttcgacgaggatggctttaaagagcgtaacctaaatgacacgcgctatgttaaccggttcctgtgccagtttgtggccgatagaatgaggctcaccgggaaggggaaaaagcgagtcttcgcttcaaacggccaaataacaaatctgcttcggggtttctgggggttgcgcaaagtgagagcagaaaacgacaggcaccatgccctggatgctgtagttgtggcctgtagcactgtcgcaatgcagcagaagatcacccggtttgtgcgatacaaggagatgaatgcgttcgacggcaaaacaattgataaggaaactggagaggtcttacaccagaaaacccattttccccaaccttgggagttctttgcccaggaagtgatgatcagagttttcggcaagccagacgggaaaccggagtttgaagaggctgacacacccgaaaagctccgcaccctgcttgccgagaagctgtcctctaggcctgaggcagtgcacgaatatgtaactccattgttcgtcagccgtgctcccaaccggaaaatgtcaggacagggtcacatggagacggtgaagagtgccaaaagactcgatgaaggcgtttccgtgctgagggtccctctaacacaactgaagctcaaagacctggagaagatggtgaatcgcgaacgagagccaaaactttacgaggcattgaaggccagactggaagctcataaggatgaccccgcgaaagcctttgcagagccgttctataagtacgataaagctgggaaccggacccagcaggtaaaggccgtgagggttgaacaggtccagaaaactggagtgtgggtgcgcaatcacaacggcatcgccgacaatgctaccatggtccgtgttgatgtgtttgagaagggtgacaagtattacttagtgcctatttacagctggcaagtagcaaaagggatactcccagatagagccgtcgtggcgtatgctgacgaagaggattggacagttatcgacgagtctttccggtttaagttcgtgctgtactcaaacgatcttattaaagtccagctgaagaaagacagtttcctaggctattttagcggactcgacagggccaccggcgcaatctccctgcgcgaacatgatttggagaagtctaaggggaaagacggaatgcaccgaattggcgtgaagactgccctgtcgttccagaaataccaaatcgatgaaatgggtaaggagataagaccctgccggcttaaaaagaggcctcccgttcgctga

SEQ ID NO: 2705 - RNA, 3246 nt, synthetic construct
  misc_feature 1..3246: note = Cas9 variant
  source 1..3246: mol_type = other RNA
atggccgctttcaagcccaaccctatcaattacattctgggcctcgacatagggatcgcaagcgtgggatgggccatggtcgagattgatgaagacgagaacccaatctgccttattgatctgggtgttagagtgtttgaaagggcggaggtaccgaaaaccggcgactccttggctgccgcacggcgcttagcccgatctgtgcgtagactgacaaggcggcgcgctcacagactactcagggcacggcgcctgcttaagcgagaaggggtcctgcaggccgctgatttcgacgagaatggattgatcaaatcactccccaacactccttggcaactgagaagtgccgcgctggataggaagctcacgccattagagtggagcgcagtgctgcttcatttgataaaacaccggggctatctgtcccagcgtaagaatgaaggtgagaccgccgacaaggaactaggggctctcctgaaaggagttgccgataacgcacatgctctacagacaggcgactttcgcactcccgccgagctggcgttgaataagttcgagaaagaatctggccacatcagaaacaggcggggagattactcgcataccttttcacgaaaggacctccaggccgagctggatttactgttcgaaaaacaaaaggagtttggaaatcctcacattagcgacgacctcaaggaaggtatcgagacacttctgatgacccagcgcccagcattgagtggcgatgctgtgcagaaaatgctagggcactgtactttcgagcccacagaacctaaggccgctaaaaacacctatacggccgagagatttgtctggctgactaagctcaataacctgaggattcttgaacagggatccgagcggccactgaccgacacagaacgcgcaactttgatggatgagccgtacagaaaatctaagctcacctatgcccaagctaggaaactgttagagctggacgatacagcgttctttaagggcctacgttacggtaaggacaatgcagaagccagcaccctcatggagatgaaggcttatcatgccatctcccgggcactggaaaaagaggggcttaaagataagaaatcacccttgaacctgagtcctgaactccaggacgagataggaacggccttcagcctgtttaagactgatgaggacattacaggccgacttaaggatagagtgcagccagaaatcctggaggtattgctcaaacacatttctttcgacaagttcgttcagatctccctgaaggctttaaggcgcatcgtgcccctgatggaacaaggcaaacggtacgacgaggcctgcgcagagatttacggggatcatgacgggaaaaagaataccgaagagaagatatatctacctccaatccccgcggatgaaattagaaacccggtcgtgctcagggctctgtcacaggcccgcaaagtgatcaacgcagtcgttcgacggtacggtagccctgcccgtatacacattgagactgctagagaagtgggcaagagttttaaagacaggaaggagatcgagaaacgccaggaagagaatcggaaggatagagaaaaggccgcagctaaattcagggagtattttcccaacttcgtaggggaaccaaagtctaaagacatccttaagttgcgactgtacgagcaacagcacggaaaatgtctctattccggcaaggagattaatctgggtcgcttaaacgaaaaagggtacgtggagatcgatcatgccctgccttttagccggacatgggacgattcgttcaataacaaggtccttgtgttgggctctgaaaatcagaacaagggaaatcagaccccctatgagtactttaacggcaaagacaattccagagaatggcaagagttcaaggcgagggttgagacgtcacgttttccacgcagtaaaaagcagcggattctcctgcagaaattcgatgaagaggggtttaaggaaagaaacctaaatgacaccaggtacgtgaaccgattcctgtgccagtttgtcgccgatcacatgctcctgacaggaaagggtaaacggcgcgtgttcgctagcaatggccaaataactaaccttttgagagggttctggggactgaggaaggtacgggcagagaacaatcgacatcacgccttagacgctgttgtggtcgcctgttccaccgtggcaatgcagcagaaaatcacaagatttgtccgctataaggagatgaacgcgttcgacggcaaaactattgataaggaaaccggtgaggtgctccatcagaagacacactttccccaaccttgggagttctttgcccaggaggttatgatcagggtgttcgggaaaccagacggcaagccggaatttgaggaggctgatacccccgaaaaactgcgtactcttctggccgagaagttgtctagccggcctgaagcagtacacgagtacgtcacgccactcttcgtgtcaagagctcccaataggaaaatgagtggacagggccatatggaaacagttaagtccgccaagcgcctggacgagggggtgagcgtcctacgagtgcctctgacccagctcaaactgaaggatcttgagaaaatggtaaacagagaacgggagccaaagttgtatgaagcactgaaagccaggttagaggctcacaaggacgatcccgcgaaagcctttgcagaaccgttctacaagtatgacaaggctggaaatcgcactcaacaggtgaaagccgttcgtgtcgaacaggtgcaaaagaccggtgtgtgggtcagaaaccataatggcatcgccgataacgctacaatggttcgggtggacgtgtttgagaaagcagggaagtactatctcgtacctatttactcttggcaggtcgccaaaggaatactgccagatagggcggtggttgcttacgccgacgaagagggctggaccgtgatcgatgaatcattccgctttaagttcgtcctttatagtaatgacctgattaaggtgcagcttaaaaaggacagcttcctcggttacttttccgggctggatcgagcaactggcgccatctctttgagagagcacgacctggagaaatcgaagggaaaagatggcatgcaccggattggggttaagacagctctcagcttccagaagtatcaaatcgacgaaatgggaaaagagataaggttatgccgcctgaagaaaagaccccctgtgaggtga

SEQ ID NO: 2706 - RNA, 3246 nt, synthetic construct
  misc_feature 1..3246: note = Cas9 variant
  source 1..3246: mol_type = other RNA
atgaccgccttcaagcccaaccctatcaattacattctgggcctcgacatagggatcgctagcgtgggatgggcaatggtcgagattgatgaagaggaaaacccaatcagacttattgacctgggtgttagggtgtttgagcgggccgaagtaccgaaaacaggcgattccttggcggctgcccgccgattagcacgttctgtgagaaggctgactcggcgcagagcccacaggctactccgggctcgccgactgcttaagagagagggggtcctgcaggcagccgacttcgatgagaatggattgatcaaatcactccccaacacgccttggcaactgagggctgccgcgctggaccggaagctcaccccattagaatggagtgcagtgctgcttcatttgataaaacaccgtggctatctgagccagcgcaagaatgagggtgaaacagccgataaggagctaggggctctcctgaaaggagttgccgacaacgcacatgcccttcagactggcgattttagaacccccgctgagctggcggtgaataagttcgaaaaagagtccggccacatcaggaaccagcgaggggactactctcatacattttcgcggaaggatttgcaagccgaactcgtcctgttattcgagaaacagaaggaatttggaaatcctcacatttcagacggtctgaaggagggcatcgagaccctccttatggcacagcgcccagctctgagcggggatgccgtgcagaaaatgttgggatattgcactttcgaacccacagagcctaaggctgccaaaaacacctacacggcagaaagatttatttggctaactaagctgaataacctcaggatcctggagcaaggcagtgaacggccacttaccgacacagagcgcgccactctgatagacatgccgtataaaaataagttgacctacgctaaagcgagagagctcctgggtttagatgacacagcattctttaaggggctgaggtatggaaaggataacgccgaatccgctaccctaatggagatgaaagcctaccacgcaattcgtcgggccctcgaaaaggagggcctgaaagacaagaaatctccccttagcttgtcccctgaactgcaggatgagatcggcacggctttctcactctttaagactgacgaggatattacagggcgactgaagggatgtcttcagccagaaatcctggacgccttgctcaaacatatcaatttcgataagttcgtacagattagtctgaaagcattaagaaggatagttcccctgatggagcaaggtaagcgctacgacgaagcgtgcgctgagacctatggcgatcactacggggagaaaaacagcgaagagatgctatatctccctccaatccccgccgacgaaattcggaacccggtggtcctgagagcactttctcaggccaggaaggtgatcaatggagtggtccgccgatacggctcccctgctcggatacatattgagactgcccgtgaagttggtaagtcatttaaagacagaaaggagatcgagaaaaggcaggaagagaaccgcaaggatcgggaaaaagcagctgccaagttcagagagtattttcccaatttcgtgggggaaccaaagagcaaagacatcttgaagctgaggctctacgagcaacagcacggcaaatgtctgtatagtggaaaggcgattgatatccgacgcttaaacggcaaagggtacgtagagattgaccacgccctgcctttttctcggacatgggatgactccttcaataacaaggtgcttgtcttgggaagcgaaaatcagaacaaaggtaatagaaccccctacgagtatctcaacggcaaggataattcgagggaatggctggagtttaaggctcgtgtggaaacgtctcgcttcccacattccaaaaagcagcgggttctactgcaaaaatttgacgagaaggggttcaaagagagaaacctcaatgataccaggtacgtgaaccgatttctgtgccagttcgtcgcagaccacatgcagcttacaggaaagggcaagcggcgcgtgtttgcctcaaatggtcagataactaacttgctgagagggttctggggcttacataaagtaagggctgaaaacgatcggcaccatgccctcgacgcagttgtggtcgcgtgtagtaccgtggccatgcaacagaagatcacatgcttcgtccgatataaagagatgaatgcttttgatggaaagactgtggacaaagaaaccggcgaggttctgcaccagaagacacacttcccccagccttgggagtttttcgcccaagaagtgatgattagagtatttgggaagccagacggaaaaccggagttcgaagaggcagatacccccgaaaaacttcgcgctctgttggccgagaagctcagctccaggcctgaggcagtccatgaatacgtgactccactgtttgtttctcgtgcccccaaccggaagatgagcggtgctcacaaagacacgctaagatcagcgaagaggttcgtgaagcataatgagaaaatcagtgtcaagcgcgtgtggctgacagaaatcaaactcgccgatctggagaacatggtaaattataagaacggccgagaaattgagctttacgaggcattgaaagctagactgggggcctatggaggcaatgccaagcaggcttttgaccctaaagataacccattctacaagaagggtgggcagttagtgaaagcagttcgggtcgaaaagacccaggagtccggcgtgctcctgaataaaaagaacgcctacactatagcggacaatggagatatggtgagggtcgacgtgttttgtaaagttgataagaagggcaaaaaccaatatttcatcgtgcccatttacgcttggcaggtagccgaaaatatccttccggacattgattgcaaggggtatcgcatcgacgatagctacaccttttgtttctctctgcacaaatatgacctaatagcattccagaaggacgagaaatcaaaggtcgaatttgcctactatatcaactgcgatagtagcaatggacgtttctacctcgcttggcacgacaagggctccaaagagcaacagtttagaatttctacacagaacctggtgttgatgcagaagtaccaaatcgatgagctgggtaaagaaattcggccttgtaggttaaagaaacgcccacccgttcgatga

SEQ ID NO: 2707 - RNA, 3246 nt, synthetic construct
  misc_feature 1..3246: note = Cas9 variant
  source 1..3246: mol_type = other RNA
atggccgctttcaagcccaaccctatcaattacattctgggcctcgacatagggatcgcaagcgtgggatgggccatggtcgagattgatgaagacgagaacccaatctgccttattgatctgggtgttagagtgtttgaaagggcggaggtaccgaaaaccggcgactccttggctgccgcacggcgcttagcccgatctgtgcgtagactgacaaggcggcgcgctcacagactactcagggcacggcgcctgcttaagcgagaaggggtcctgcaggccgctgatttcgacgagaatggattgatcaaatcactccccaacactccttggcaactgagaagtgccgcgctggataggaagctcacgccattagagtggagcgcagtgctgcttcatttgataaaacaccggggctatctgtcccagcgtaagaatgaaggtgagaccgccgacaaggaactaggggctctcctgaaaggagttgccaacaatgcacatgcccttcagacaggcgattttcgcactcccgctgagctggcgttgaacaagttcgagaaagaatctggccacatcagaaatcagcgaggggactactcgcataccttttcacggaaggatctccaagccgagctgattttactgttcgaaaaacagaaggagtttggaaaccctcacgtgagcggtggcctcaaggaagggatcgagacacttctgatgacccagcgaccagcattgagtggagacgctgtccagaaaatgctaggccactgtactttcgagcccgccgaacctaaggctgccaaaaatacatataccgcagagcgctttatttggctgacgaagctcaacaatctgagaatccttgaacaaggttccgagaggccactgactgataccgaacgggccacattgatggacgagccgtaccgcaaatctaagctcacttatgctcaggcgagaaaactgttagggctggaggacaccgcattctttaagggactaaggtacggcaaggataacgccgaagctagcacactcatggagatgaaagcctatcatgcaatatcccgtgccctggaaaaggagggccttaaagacaagaaatcacccttgaatctgagtcctgaactccaggatgagattgggaccgctttcagcctgtttaagacggacgaggatatcactggacggcttaaggacaggattcagccagaaatcctggaggccttgctcaaacacatctctttcgataagttcgtgcaaatttccctgaaagcattaagaaggatagtacccctgatggaacagggtaagcgctacgacgaggcgtgcgctgagatctacggcgatcattatgggaaaaagaacacagaagagaagatttacctacctccaatccccgccgacgaaatacggaacccggttgtgctcagagcactgtcacaggccaggaaagtcattaatggagtggtgcgccgatatggcagccctgctcggatccacatcgagaccgcccgtgaagtcggtaagagttttaaagatagaaaggagattgagaaaaggcaagaagagaaccgcaaggaccgggaaaaggcagctgccaaattcagagagtactttcccaatttcgttggggaaccaaagtctaaagacatccttaagttgaggctgtatgagcagcagcacggcaaatgtctctactccggaaaggagattaacctgggccgattaaatgaaaaagggtatgtggagatagatcatgcgctgccttttagccgcacttgggacgattcgttcaacaataaggtacttgtgttgggatctgaaaaccagaataagggtaaccaaacaccctacgagtactttaatggcaaagacaactcccgggaatggcaggagttcaaggccagagtcgagacctcaaggtttccacgtagtaaaaagcagcgcatcctcctgcagaaattcgatgaagacgggtttaaggagcggaatctaaacgatacgagatatgtgaataggttcctgtgccaatttgttgctgaccgaatgcggctcaccggaaagggcaaaaagcgcgtgttcgcaagcaacggtcagattacaaacctgcttagagggttctggggcttgaggaaagtccgggccgaaaatgatcgacaccatgctctggacgccgtggtagttgcatgttccactgtggcgatgcagcagaagatcaccagatttgtccgctacaaagagatgaacgccttcgatggaaagacaatcgacaaggagactggcgaagtgttacaccagaaaacccattttccccagccttgggagttctttgctcaggaagtcatgattagggtgttcgggaagccagatggaaaaccggagtttgaagaggccgacacacccgagaagctccgtaccctgcttgcagaaaaactgtctagccggcctgaggctgttcacgaatatgtgactccattgttcgtatcaagagcccccaataggaagatgagtggtcagggccacatggagacggtcaagtccgcaaaacgcctcgacgaaggggtgagcgttctgcgagtgcctctaacacaactgaagctcaaagatctggagaagatggtcaacagagagcgggaaccaaaactttacgaggccttgaaggctaggctggaagcgcataaagacgatcccgccaaggcatttgctgagccgttctataagtacgacaaagccggaaatcgcacccaacaggtgaaggccgtacgtgtggaacaagttcagaaaactggcgtctgggtgagaaaccacaatggtatagctgataacgcaaccatggtgcgggtcgacgtttttgagaaggccgggaaatattacttagtgcctatctactcttggcaagtggcgaagggcattctcccagatagggctgtagtcgcctatgcagacgaggaaggatggacagtgatcgatgagtcattccgctttaagttcgttctgtacagtaatgaccttattaaagtgcagctgaagaaagatagcttcctaggctatttttccgggctcgaccgagccaccggagctatctctctgagagaacatgatttggagaagtcgaaaggcaaggacggtatgcaccggataggggtcaagactgcactgagcttccagaaataccagatcgacgagatgggaaaggaaattaggttatgccgcctcaaaaagagaccccctgtgaggtga

SEQ ID NO: 2708 - RNA, 3246 nt, synthetic construct
  misc_feature 1..3246: note = Cas9 variant
  source 1..3246: mol_type = other RNA
atgctgaagagagtgctcggcatcgacgtcgggattagctccataggatgggcccttctggagttccagggtgatatcgacaacaaagatttgccctctggcaagattttagcttcaggggttagggtgtttacccaagcagaaaatcctaaaaacggagagagtctggccaagccacggcgcgacgcgcgactagctcgtagaaggacacggcgcagagcccagaggctcactgatatcaaagacctgttctttaagtacaaacttgtaacgggcattagccggaataaaatcaactccatatataagaccgaagagaataaaaaggatccgtggacactgcgcaaagaagcattgtaccgaaagctcgacggtgaggagttcgccagagtgctgactcacatcgctaagcatagggggtttaaatctatgcggaagtcggaagaggaaggatcagataccaaagcaaaggagacacagcgtgtcctgaccgagattggcaaaaacaaggacactctcaaaacaggcatctggcagaccgccggggaaatgattgctagccgccccaagggagatgccagaaggaataagacggacagttataaaaactccatctctcgggagttactgcaagatgaaactaagataattttcgagaaacagcgaggtatgaatagccagtttacctccgcggaccttgaaaaggagtactcagacatcgcattccaccaggcccctattcaaagtatgttgaaaatggtgggcgggtgcacatttgagaaggatgaagagggaaagcgcctgaaaagagctccaaagaacagctattctgccgaagttttcactgcactaaccaaaatcaataacctcgtgctgaagacaaaaaccgctaatatcaacgacaggtttcttacgactgaggaacggaagaaggccctggagttgtgtcattccaatgcgaaagtcacattcaagcagctccgcggcgagctgggtttacccgaagattggatttttaacaccgtggactacgccaaaaagcctaaaaagactgcagtaaaggagacagaaccagagtcagcttgcttcttccagatgagagggtataacgaaataaggaaaagcgttggaaaggatctgtggaccgagatcagtatgaaaaaggagattctcaattctatcgtgacgacccttgccacagaaaaatccgacgaggctataaaggcccagctgaaaaagagcgaagtccccgatgagattgcagagaaggtgttgggcctaaactttcgtggcttcctgcacctctcgatcaaagccctggacaagatcattccttttatgatggctggggataaatacactgacgcgtgtgataaggcaggatacaaagaacaaatctctggtattaagaagatattccttcggaaactgaatgacgaggaaaacgagcagatcaccaatccagtggccaagcgagctattacacagtttagaaaagtcatcaacgccatcattagggaatatggcaagttcgaccaaatgaatatagagttggcacgcgatctcgccaaatcctacgacgatcggaagaagatcaaagaggggcaggaagactttagagctgagaaggatagggccgcacagcgctgcaaagacaacggactggatccaaattcaaaggacaacttaagtaaatatcgactgtgggaacagcaagataatggcttctgtatttactgcggtaagcccatcgagctacagcggctcgcggaacaggggtattgtgaggttgaccatattctgccttacagccgttcccttgatgactctcagcacaacaaggtgttggctcacatccatgataatcaacagaaaaagaaccagataccatttgagcacttcggcggagacggccccaaatgggaagagtttgtagggagactgaatagccagttcaagaacctccctaaatcaaagctgaacaggcttgtgaaacgcaagtttgacgaaaaggatatggagggattcaaagaacggaatatcaacgacactagatatattagtaggttcatcaagaattttgtcgagaaccatctggagttcgccgaatccgcacaaaaacagaaggtgtttgttcgaagcggttctttgaccgccttcctccgccaccagtggggcctgattaaaaagcgggatgagtcagacagacaccatgctttagatgccctggtgacagcatgcgctacccaggccatggtcaagagtactgcgatcacggcccaaaagatggaaagctacaattggataaacaaggagaaaccaaggatgcccctaccgtggctcaattttcgtgacgatgtgcagaagtccctggacgctgtattcgtttctcgcgcacctcggcacaaagtcgggggagccgctcataaggagacaattagatcgatcaggaagtgtggcgaagagaaccttattatcgaaaagacccccttggtggatatagccactaagagcggtatcaaactgaaggacattgagaaactctacaagaaggaacagaatcgaaaactgtatgagaccttaaaggagcggctggaacaaaacgggaatgatccagtgaaagcatttggcaaccctgacgatcccgtccgcatgccaacaaatgaccttaccaagactggacccatcattaaatccatcaagttgataacaaacaagaaatcaggcctcaatgtgagagcggggattgccgacaacggagagatcgctaggctggatgtttacgaacggaagggtaaattctatctaatccctaactacgtggccgactttgcaaataaggagctgccgaaaaaggctattaaagccaacacgccggaaaccgagtggcccatcattgatcgaaattataacttcaagtttagtctcttcaaggacgatctgatatctatcaaacagaaacttgacagccctgaggaattttactattacaaaggcccagatgtatccactgcatcaattacagtcgagagcgtggacagaaagcgcttgtgggaagagaaaaagaaggggaaaatcgaaaatgttttccacaccaggattggaacaaagactctgaaatctttccgtaagtttaacttagatatcctcggcaccaaagcccccgtggagataaagaaggagacgtgggtcggtgtgatccggaaaaatggggtagctaacaataccggcaacaaggcgatgtga

SEQ ID NO: 2709 - RNA, 3249 nt, synthetic construct
  misc_feature 1..3249: note = Cas9 variant
  source 1..3249: mol_type = other RNA
atggccgctttcaagcccaaccctatgaattacatcttaggcctcgacattgggatagcaagcgtgggatgggccatggtcgagatcgataaagaagagaacccaattagacttatcgacctgggtgttagggtgtttgaacgggcggaggtaccgaagaccggcgattccttggctatggcccgccgattagcacgttctgtgagaaggctgacacggcgcagagcccacaggctactccgggctcgccgactgcttaaaagagaaggggtcctgcaggacgcagatttcgacgagaatggattggtgaagtcactccccaacactccttggcaactgagggccgctgccctggatcggaaactcacgtgcttagagtggagtgcggttctgcttcatttgattaagcaccgtggctatctgagccagcgcaagaatgaaggtgagaccgcagacaaagaactaggggccctcctgaagggagtggctgataacgcccatgcacttcagacaggcgactttagaactccagctgagctggccttgaataaattcgagaaggaatccggccacatcaggaaccagcgaggggattactctcataccttttcgcggaaagacctccaagcggagctgaatttactgttcgaaaagcagaaggagttttcaaacccccacgtcagcgatagtctcaaagaaggaatagagacacttctgatggcccagcgccctgcattgtccggtgacgctgtgcagaagatgctaggccactgtaccttcgagccagccgaacccaaagctgccaagaatacttatacagcagagagatttatctggctgaccaaactcaacaatctgaggattcttgaacaagggtctgagcggcctctgacggacactgaacgcgccaccttgatggatgagccatacagaaagagcaaactcacatatgctcaggcgaggaagctgttaggactggaggacactgcattctttaagggcctacgttacggtaaagataacgccgaagctccgaccctcatggagatgaaggcctatcatgcaatctcccgggccctggaaaaagaggggcttaaggacaaaaagtcacccttgaatctgagtacagaactccaggatgagattggaaccgctttcagcctgtttaagacggacaaagatatcactggccgacttaaggacagagtacagcctgagatactggaagccttgctcaaacacatttctttcgataagttcgttcaaatctccctgaaagcattaaggcgcattgtgccactgatggagcagggcaagcggtacgacgaagcgtgcgctgagatctacggggatcattattgtaagaaaaacgccgaggaaaagatctacctaccccctattccagcagacgagataagaaaccccgtcgtgctcagggccctgtcacaggctcgcaaagtgatcaattgcgtcgttcgacggtatggaagcccggcccgtattcacatcgaaacagcaagagaggtgggtaagagttttaaagacaggaaggaaatagagaagcgccaagaggaaaaccggaaagatagagagaaggctgccgcgaaattcagggaatactttcctaatttcgtaggcgagcccaagtctaaagacattcttaagttgcgactgtatgaacagcagcacgggaaatgtctctactccggaaaggagatcaacctggtgcgcttaaatgagaagggctatgtcgaaatcgatcatgccctgccatttagccggacctgggacgattcgttcaacaataaagtgcttgttttgggttctgagaaccagaataaggggaaccaaactccttacgaatactttaatggcaaagacaactccagagagtggcaggagttcaaggctagggtggaaacatcacgttttccccgcagtaaaaagcagcggattctcctgcagaagttcgatgaggaaggatttaaagagagaaatctaaacgacaccaggtatgtcaatcgattcctgtgccaatttgtggcagatcacatcctcctgacgggcaaggggaaacggcgcgtattcgccagcaacggacagattaccaaccttttgagaggtttctggggcctgaggaaggttcgggctgaaaatgaccgacatcacgccttagatgcagtggtcgtggcgtgttccacagtcgccatgcagcagaaaataactagatttgtgcgctacaaggagatgaacgctttcgacgggaagaccatcgataaagagacaggagaagttctccatcaaaaggcccactttccacagccctgggagttctttgcacaggaagtgatgattagggtattcggcaaacctgacggtaagccagagtttgaagaggctgacactccggagaaactgcgtacccttctggccgaaaagttgtctagccggcccgaggcagtccacgaatatgtgacacctctcttcgtttcaagagccccaaataggaagatgagtgggcagggccatatggagaccgtgaaatccgctaagcgcctggatgaaggaatcagcgtcctacgagtgcccctgactcaactcaaactgaagggccttgagaaaatggtaaacagagagcgggaacctaagttgtacgacgcgctgaaagcccagttagagacgcacaaggataatccagcaaaggcttttgccgaacccttctataaatacgacaaggccgggaacaggacacagcaagtgaaagctgttcgcatcgagcaggtccagaagaccggagtgtgggtgcgtaatcataacggtattgcagataatgccactatggtcagagttgacgtgtttgaaaaaggcgggaagtattacctcgtgccgatatactcttggcaggtagcgaagggaatcctgcctgatcgggctgtcgtggccttcaaagacgaggaggattggaccgttatggacgattcatttgagttcaggttcgtgctttatgcaaacgacctgattaagctaacagccaaaaagaatgaatttctcggctacttcgtcagtctgaaccgcgctaccggtgcaatcgatattcgaactcacgacacagacagcacgaaagggaagaatggcatctttcaatccgtgggagttaagaccgccttgtctttccagaaaaaccagatagatgaactgggcaaggagatcagaccatgccggctgaaaaagaggccccctgtgcgctga

SEQ ID NO: 2710 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatagggatcgcaagcgtgggatgggccatggtcgagattgatgaagaggaaaacccaatcagacttattgacctgggtgttagggtgtttgagcgggcggaagtaccgaaaaccggcgattccttggctatggcccgccgattagcacgttctgtgagaaggctgacacggcgcagagcccacaggctactccgggctcgccgactgcttaagagagagggggtcctgcaggcagccgacttcgatgagaatggattgatcaaatcactccccaacactccttggcaactgagggctgccgcgctggaccggaagctcacgccattagaatggagtgcagtgctgcttcatttgataaaacaccgtggctatctgagccagcgcaagaatgagggtgaaaccgccgataaggagctaggggctctcctgaaaggagttgccaacaatgcacatgcccttcagacaggcgactttagaactcccgctgagctggcgttgaacaagttcgaaaaagagtccggccacatcaggaatcagcggggagattactctcataccttttcgcgaaaggacctccaagccgaactgattttactgttcgagaaacagaaggaatttggaaaccctcacgtgtcaggtggcctcaaggaggggatcgagacacttctgatgacccagcgcccagcattgagcggagatgctgtccagaaaatgctaggccactgcactttcgaacccgccgagcctaaggctgccaaaaatacatataccgcagaaagatttatttggctgacgaagctcaacaatctgaggatccttgagcaaggtagtgaacggccactgactgacaccgagcgcgccacattgatggatgagccgtacagaaaatccaagctcacttatgctcaggcgaggaaactgttagggctggaagacaccgcattctttaagggactacgttacggcaaggacaacgccgaggcttctacactcatggaaatgaaagcctatcatgcaataagccgggccctggagaaggaaggccttaaagataagaaatcccccttgaatctgtcaagtgagctccaggacgagattgggaccgctttcagcctgtttaagacggatgaagacatcactggacgacttaaggatagagtgcagcctgagattctggaagccttgctcaaacacatctctttcgacaagttcgtacaaatctccctgaaagcattaaggcgcattgttccactgatggagcagggtaagcggtacgatgaggcgtgtgctgaaatatacggcgaccattatgggaaaaagaacacagaggaaaagatctacctaccccctattccagccgatgagatcagaaaccccgtggtcctcagggcactgtcacaggcccgcaaagtgataaatggagtggtccgacggtatggcagcccggctcgtattcacatcgaaaccgccagagaggttggtaagagttttaaagacaggaaggagatcgaaaaacgccaagaggaaaaccggaaggatagagagaaggcagctgccaaattcagggaatactttcctaatttcgtgggggagcccaagtctaaagacattcttaagttgcgactgtatgagcagcagcacggcaaatgcctctactccggaaaggaaatcaacctggtacgcttaaatgagaaaggctatgtggaaattgaccatgcgctgccatttagccggacttgggatgactcgttcaacaataaggtccttgtgttggggtctgagaaccagaataagggaaaccaaacaccttacgaatactttaatggtaaagataactccagagagtggcaggagttcaaggccagggttgaaacctcacgttttccccgcagtaaaaagcagcggatactcctgcagaaattcgacgaggatggctttaaggaatgtaatctaaacgacacgagatatgtgaataggttcctgtgccaatttgtcgctgatcacatcctcctgaccgggaagggaaaacgacgggtgttcgcaagcaacggccagattacaaaccttttgcgcggtttctgggggctgagaaaggtaagggccgagaatgaccggcatcacgctttagatgccgttgtggtcgcatgttccactgtggcgatgcagcagaaaatcacccgatttgtcagatacaaggagatgaacgccttcgacggcaaaacaatcgataaggaaactggaaaggtgctccatcagaaaacccactttccacagccctgggagttctttgctcaggaagttatgattcgcgtgttcggcaagcctgacgggaaaccagagtttgaagaggccgatacaccggagaagctgaggacccttctggcagaaaaattgtctagccgtcccgaggctgtacacgaatatgtcactcctctcttcgtgtcacgggccccaaatagaaagatgagtggacagggtcatatggagacggttaagtccgcaaaaaggctggacgaaggcgtgagcgtcctacgcgtgcccctgacacaactcaagctgaaagaccttgagaagatggtaaaccgagagagagaacctaaattgtacgaggccctgaaggctcggttagaagcgcacaaagatgacccagccaaggcatttgctgagcccttctataagtacgataaagccgggaataggacccaacaggtgaaggccgttcgcgtcgaacaagtgcagaaaactggagtgtgggtccgtaaccataatggcatagctgacaacgcaaccatggttagagtggatgtgtttgagaagggtgacaaatattacctcgtaccgatctactcttggcaggtcgccaaggggattctgcctgatcgggcggtggttcagggcaaggacgaggaagattggcaacttatcgacgattcattcaattttaaattcagtctgcacccaaacgacctagtggaggtcattacaaagaaagctaggatgttcggatattttgccagctgccaccgcggcaccgggaatatcaacatacgaatccatgatctcgaccacaagattgggaaaaatggcatcctggaaggtattggggtgaagactgcattgtccttccagaagtaccagatcgacgagctgggaaaagagataagaccctgtcggttaaagaaaaggcctcccgttcgctga

SEQ ID NO: 2711 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatagggatcgcaagcgtgggatgggccatggtcgagattgatgaagacgagaacccaatctgccttattgatctgggtgttagagtgtttgaaagggcggaggtaccgaaaaccggcgactccttggctatggcccggcgcttagcacgatctgtgcgtagactgacaaggcggcgcgcccacagactactcagggctcggcgcctgcttaagcgagaaggggtcctgcaggcagccgatttcgacgagaatggattgatcaaatcactccccaacactccttggcaactgagagctgccgcgctggataggaagctcacgccattagagtggagtgcagtgctgcttcatttgataaaacaccggggctatctgagccagcgtaagaatgaaggtgagaccgccgacaaggaactaggggctctcctgaaaggagttgccgataacgcacatgcccttcagacaggcgactttcgcactcccgctgagctggcgttgaataagttcgagaaagaatccggccacatcagaaaccagcgaggggattactctcataccttttcgcggaaggacctccaagccgagctgattttactgttcgaaaaacagaaggagtttggaaatcctcacgtgtcaggtggcctcaaggaagggatcgagacacttctgatgacccagcgaccagcattgagcggagatgctgtccagaaaatgctaggccactgtactttcgagcccgccgaacctaaggctgccaaaaacacatataccgcagagcgctttatttggctgacgaagctcaataacctgagaatccttgaacaaggtagtgagaggccactgactgacaccgaacgggccacattgatggacgagccgtaccgcaaatccaagctcacttatgctcaggcgagaaaactgttagggctggaggataccgcattctttaagggactaaggtacggcaaggacaatgccgaggcttctacactcatggaaatgaaagcctatcatgcaataagccgtgccctggaaaaggagggccttaaagataagaaatcccccttgaacctgtcacctgaactccaggacgagattgggaccgctttcagtctgtttaagacggatgaggacatcactggacggcttaaggataggattcagccagaaatcctggaggccttgctcaaacacatcagcttcgacaagttcgtgcaaatttctctgaaagcattaagaaggatagtacccctgatggaacagggtaagcgctacgatgaggcgtgcgctgagatctacggcgaccattatgggaaaaagaatacagaagagaagatttacctacctccaatccccgccgatgaaatacggaacccggttgtgctcagagcactgtcccaggccaggaaagtcattaacggagtggtgcgccgatatggctcacccgctcggatccacatcgagaccgcccgtgaagtcggtaagagctttaaagacagaaaggagattgagaaaaggcaagaagagaatcgcaaggaccgggaaaaggcagctgccaaattcagagagtactttcccaacttcgttggggaaccaaagagtaaagatatccttaagttgaggctgtatgagcagcagcacggcaaatgtctctactctggaaaggagattaatctgggccgattaaacgaaaaagggtatgtggagatagaccatgcgctgcctttttcccgcacttgggatgacagcttcaataacaaggtacttgtgttgggatcggaaaatcagaacaagggtaatcaaacaccctacgagtactttaacggcaaagataattctcgggaatggcaggagttcaaggccagagtcgagacctccaggtttccacgtagtaaaaagcagcgcatcctcctgcagaaattcgacgaagatgggtttaaggagcggaacctaaatgacacgagatatgtgaacaggttcctgtgccaatttgttgctgatcgaatgcggctcaccggaaagggcaaaaagcgcgtgttcgcatcaaatggtcagattacaaacctgcttagagggttctggggcttgaggaaagtccgggccgaaaacgaccgacaccatgctctggatgccgtggtagttgcatgtagcactgtggcgatgcagcagaagatcaccagatttgtccgctacaaagagatgaatgccttcgacggaaagacaatcgataaggagactggcgaagtgttacaccagaaaacccattttccccagccttgggagttctttgctcaggaagtcatgattagggtgttcgggaagccagacggaaaaccggagtttgaagaggccgacacacccgagaagctccgtaccctgcttgcagaaaaactgtcctctcggcctgaggctgttcacgaatatgtgactccattgttcgtaagcagagcccccaacaggaagatgtcaggtcagggccacatggagacggtcaagagtgcaaaacgcctcgatgaaggggtgtccgttctgcgagtgcctctaacacaactgaagctcaaagacctggagaagatggtcaatagagagcgggaaccaaaactttacgaggccttgaaggctaggctggaagcgcataaagatgaccccgccaaggcatttgctgagccgttctataagtacgataaagccggaaaccgcacccaacaggtgaaggccgtacgtgtggaacaagttcagaaaactggcgtctgggtgagaaatcacaacggtatagctgacaatgcaaccatggtgcgggtcgatgtttttgagaagggggacaaatattacttagtgcctatctacagctggcaagtggccaagggcattctcccagatagggcggtagtccagggaaaggacgaggaagattggcagctgatcgacgattctttcaactttaaattctcacttcatcccaatgacctggtggaggttattacaaagaaagctcgcatgttcggctattttgccagttgccaccgagggaccggaaacatcaatataagaatccacgacctagatcataagattggcaaaaacggtatcctcgaagggattggagtgaagactgcactgagcttccagaagtaccagatcgacgagttgggcgaggaaatacggccttgtaggctgaaaaagcgccctccagtcagatga

SEQ ID NO: 2712 - RNA, 3249 nt, synthetic construct; identical to SEQ ID NO: 2550
  misc_feature 1..3249: note = Cas9 variant
  source 1..3249: mol_type = other RNA

SEQ ID NO: 2713 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatagggatcgcaagcgtgggatgggccatggtcgagattgatgaagacgagaacccaatctgccttattgatctgggtgttagagtgtttgaaagggcggaggtaccgaaaaccggcgactccttggctgccgcacggcgcttagcccgatctgtgcgtagactgacaaggcggcgcgctcacagactactcagggcacggcgcctgcttaagcgagaaggggtcctgcaggccgctgatttcgacgagaatggattgatcaaatcactccccaacactccttggcaactgagagccgcggcactggataggaagctcacgccattagagtggagtgccgtgctgcttcatttgataaaacaccggggctatctgagccagcgtaagaatgaaggtgagaccgctgacaaggaactaggggccctcctgaaaggagttgcagataacgctcatgcccttcagacaggcgactttcgcactcccgcggagctggccttgaataagttcgagaaagaatccggccacatcagaaaccagcgcggggattactctcataccttttcgcggaaggacctccaagcagagctgattttactgttcgaaaaacagaaggagtttggaaatcctcacgtgtcaggtggcctcaaggaagggatcgagacacttctgatgacccagcgaccagctttgagcggagatgccgtccagaaaatgctaggccactgtactttcgagcccgctgaacctaaggccgccaaaaacacatataccgcagagcgctttatttggctgacgaagctcaataacctgagaatccttgaacaaggtagtgagaggccactgactgacaccgaacgggctacattgatggacgagccgtaccgcaaatccaagctcacttatgcgcaggcaagaaaactgttagggctggaggataccgccttctttaagggactaaggtacggcaaggacaatgctgaagcctctacactcatggagatgaaagcatatcatgccataagccgtgctctggaaaaggagggccttaaagataagaaatcccccttgaacctgtcacctgaactccaggacgagattgggaccgccttcagtctgtttaagacggatgaggacatcactggacggcttaaggatcgagtgcagccagaaattctggaggcattgctcaaacacatcagcttcgacaagttcgtacaaatctctctgaaagcgttaagaaggattgttcccctgatggaacagggtaagcgctacgatgaggcttgcgccgagatatacggcgaccattatgggaaaaagaatacagaagagaagatctacctacctccaattcccgcagatgaaatccggaacccggtggtcctcagagccctgtcccaggctaggaaagtgataaacggagtggtccgccgatatggcagccctgcccggattcacatcgagaccgcacgtgaagttggtaagtcatttaaagacagaaaggagatcgagaaaaggcaagaagagaatcgcaaggaccgggaaaaggctgccgcgaaattcagagagtactttcccaacttcgtgggggaaccaaagagtaaagatattcttaagttgaggctgtatgagcagcagcacggcaaatgtctctactctggaaaggagatcaatctgggccgattaaacgaaaaagggtatgtagagattgaccatgccctgcctttttcccgcacttgggatgacagcttcaataacaaggtgcttgtcttgggatcggaaaatcagaacaagggtaatcaaacaccctacgagtactttaacggcaaagataattctcgggaatggcaggagttcaaggctagagtggagacctccaggtttccacgtagtaaaaagcagcgcatactcctgcagaaattcgacgaagatgggtttaaggagcggaacctaaatgacacgagatatgttaacaggttcctgtgccaatttgtggcagatcgaatgcggctcaccggaaagggcaaaaagcgcgtcttcgcctcaaatggtcagatcacaaacctgcttagagggttctggggcttgaggaaagtgcgggctgaaaacgaccgacaccatgccctggatgcagtagttgtggcgtgtagcactgtcgccatgcagcagaagattaccagatttgtgcgctacaaagagatgaatgctttcgacggaaagacaatcgataaggagactggcgaagtcttacaccagaaaacccattttccccaaccttgggagttctttgcccaggaagtgatgatcagggttttcgggaagccagacggaaaaccggagtttgaagaggcagacacacccgagaagctccgtaccctgcttgctgaaaaactgtcctctcggcctgaggccgtgcacgaatatgtaactccattgttcgtcagcagagcacccaacaggaagatgtcaggtcagggccacatggagacggtgaagagtgccaaacgcctcgatgaaggggtttccgtgctgcgagtccctctaacacaactgaagctcaaagacctggagaagatggtgaatagagagcgggaaccaaaactttacgaggctttgaaggcgaggctggaagcccataaagatgaccccgcaaaggcttttgccgagccgttctataagtacgataaagccggaaaccgcacccagcaggtaaaggctgtgcgtgttgaacaagtccagaaaactggcgtgtgggtgagaaatcacaacggtattgcagacaatgccaccatggtccgggttgatgtgtttgagaagggggacaaatattacttagtgcctatatacagctggcaggtagcgaagggcatcctcccagatagggctgtcgtgcagggaaaggacgaggaagattggcaactgattgacgattctttcaactttaaattctcacttcatcccaatgacctggttgaggtgatcacaaagaaagcccgcatgttcggctattttgcaagttgccaccgagggaccggaaacattaatatcagaatacacgacctagatcataagatcggcaaaaacggtattctcgaagggatcggagtcaagactgccctgagcttccagaagtaccagattgacgagttgggcaaagagatccggccttgtaggctgaagaaaaggcccccagtgagatga

SEQ ID NO: 2714 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatagggatcgcaagcgtgggatgggccatggtcgagattgatgaagaggaaaacccaatcagacttattgacctgggtgttagggtgtttgagcgggcggaagtaccgaaaaccggcgattccttggctatggcccgccgattagcacgttctgtgagaaggctgacacggcgcagagcccacaggctactccggactcgccgactgcttaagagagagggggtcctgcaggctgcaaatttcgacgagaacggattgatcaaatcactccccaatacgctgtggcaactgagggccgctgccctcgatcggaagttaacccctctggaatggagtgcggtgcttttgcatctgataaaacaccgtggctatctaagccagcgcaagaacgagggtgaaacagcagacaaggagctcggggccctgcttaaaggagttgctggcaatgcccatgcactgcagactggcgattttagaaccccagctgagttggccctcaacaagttcgaaaaagagtccgggcacatcaggaatcagcggggagactactctcatacattttcgcgaaaggatctgcaagcggaattaaacctcctcttcgagaaacagaaggaatttggtaatccccacatttcagacggccttaaggaggggatcgagaccctgttgatgactcagcgccctgccctaagcggagatgcagtgcagaaaatgctgggccactgcacattcgaaccaaccgagcccaaggctgccaaaaacacgtatactaccgaaagatttatttggctcacaaagctgaataaccttaggatcctggagcaaggtagtgaacggcctttgactgacaccgagcgcgctacactcatggatgagccatacagaaaatccaagctgacctatgcccaggcaaggaaattactggaactagacgacatagccttctttaaggggctccgttacggaaaggataatgctgaggcgtctacgctgatggaaatgaaagcatatcatgccattagccgggctcttgagaaggaaggcttgaaagacaagaaatccccgctgaacctctcacccgagctgcaggatgagatcggcactgccttcagtctttttaagacagacgaagatattaccgggcgactgaaggacagaatccagcctgagatcttggaagcactcctgaaacacattaacttcgataagttcgtccaaatcagcttaaaagccctgaggcgcatagtgccactaatggagcagggaaagcggtacgacgaggcttgtgccgaaatttacggtgatcattatggcaaaaagaatactgaggaaaagatcgacctgccccctataccagcagatgagattcacaaccccgtagttctgagagcgctttctcaggctaggaaagtgatcaatggggtcgtgcgccgatacggatccccggcccggatccacattgaaacagcacgtgaggtgggcaagtcatttaaagacagaaaggagatcgagaaaaggcaagaagaaaaccgcaaggaccgggagaaggccgctgccaaattcagagaatattttcctaatttcgtcggtgagcccaagagcaaagatattttgaagctgaggctctacgagcagcagcatgggaaatgcctgtatagtggcaaggaaataaacttaggacgactgaatgagaaaggctacgttgaaatcgaccacgcacttccattttctcgcacctgggatgactccttcaacaataaggtgttggtactcgggagcgagaaccagaataagggaaaccaaacgccttatgaatactttaatggtaaagataactcgcgggagtggcaggagttcaaggctagagtggaaacctctaggtttccccgttccaaaaagcagcgcattctgctacagaaattcgacgaggatggctttaaggaacggaatctgaacgacacaagatacgtcaacaggttcctctgtcaatttgtggccgatcgaatgcggctgactgggaagggcaaaaagcgcgttttcgcgtcaaatggacagatcaccaaccttttgagaggtttctgggggctgaggaaagtgcgggccgagaatgaccgacatcacgctttagatgcagtcgtggtagcctgcagtacagttgctatgcagcagaagatcactagatttgtgcgctataaagagatgaacgccttcgacggcaagaccattgataaggaaacaggagaggtcctccatcagaaaacccactttccacagccctgggagttctttgcacaggaagtgatgataagggtcttcggcaagcctgacgggaaaccagaatttgaggaggcggacactccggaaaagctgcgtacgcttctgacagagaaattgagctcccggcccgaagccgtgcacgagtacgttacccctctcttcgtgtctagagctccaaataggaagatgagcggacagggtcatatggaaactgtaaagtcagccaaacgcctggatgagggcatcagtgtcctacgagtgcccctgacccaactcaagctgaaagaccttgagaagatggttaacagagaacgggagcctaaattgtatgaagcactgaaggctaggttagaggcccacaaagatgacccagcaaaggcctttgctgaacccttctacaagtatgataaagcggggaatcgcacacaacaggtgaaggccatgcgtgtcgagcaagtgcagaaaaccggagtatgggtgagaaaccataatggcattgcagacaacgctactatggttcgggtcgatgtgtttgagaagggtgacaaatactatctcgtgccgatctactcctggcaggtcgccaaggggattctgcctgatagggccgttgtgcagggcaaggacgaagaggattggcaacttatcgacgatagcttcaattttaaattctctctgcacccaaacgacctagtggaagtaataacaaagaaagctcgcatgttcggatactttgcatcatgtcaccgaggcacggggaatatcaacattagaatccatgacctcgatcacaagattggcaaaaatggaatcctggagggtataggggtcaagaccgccttgagtttccagaagtatcagattgacgagctgggaaaagaaatccggccctgcaggttaaagaaacgccctcccgtgagatga

SEQ ID NO: 2715 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatagggatcgcaagcgtgggatgggccatggtcgagattgatgaagacgagaacccaatctgccttattgatctgggtgttagagtgtttgaaagggcggaggtaccgaaaaccggcgactccttggctatggcccggcgcttagcacgatctgtgcgtagactgacaaggcggcgcgcccacagactactcagggctcggcgcctgcttaagcgagaaggggtcctgcaggcagccgatttcgacgagaatggattgatcaaatcactccccaacactccttggcaactgagagctgccgcgctggataggaagctcacgccattagagtggagtgcagtgctgcttcatttgataaaacaccggggctatctgagccagcgtaagaatgaaggtgagaccgccgacaaggaactaggggctctcctgaaaggagttgccgataacgcacatgctttacagacaggcgactttcgcactcccgccgagctggcgttgaataagttcgagaaagaatccggccacatcagaaaccagaggggagattactctcataccttttcgcggaaggacctccaagccgagctgaatttactgttcgaaaaacagaaggagtttgggaaccctcacatttcagatggtctcaaggaaggcatcgagacacttctgatgacccagcgaccagcattgagcggggacgctgtgcagaaaatgctaggacactgtactttcgagcccgccgaacctaaggctgccaaaaatacatataccgcagagcgctttatttggctgacgaagctcaacaatctgagaatccttgaacaaggcagtgagaggccactgactgacaccgaacggacaactttgatagatgagccgtaccgcaaatccaagctcacctatgcccaggctagaaaactgttagagctggacaacacagcgttctttaagggtctaaggtacgggaaggataatgcagaagcctctaccctcatggagatgaaggcttatcatgccattagccgtgcactggaaaaagagggacttaaagacaagaaatcccccttgaacctgtcacctgaactccaggatgagatcggcacggccttcagtctgtttaagactgacgaggatattacaggccggcttaaggaccgagtccagccagaaatcctggaggctttgctcaaacacatcagcttcgataagttcgtgcaaatttctctgaaagccttaagaaggatagtacccctgatggaacaggggaagcgctacgacgaggcatgcgcggagatctacggagatcattatggtaaaaagaacaccgaagagaagattgacctacctccaatccccgctgacgaaatacggaatccggttgtgctcagagccctgtcccaggcaaggaaagtcattaacggcgtggtgcgccgatacgggagccctgcccggatccacatcgagactgctcgtgaagtcggaaagtcatttaaagatagaaaggagattgagaaaaggcaagaagagaatcgcaaggaccgggaaaaggccgcaacaaaattcagagagtattttcccaacttcgttggcgaaccaaagagtaaagatatccttaagttgaggctgtacgagcagcagcacggtaaatgtctctattctgggaaggagattaatctgggccgattaaacgaaaaaggatacgtggagatagaccatgctctgcctttttcccgcacctgggatgacagcttcaataacaaggtacttgtgttgggctcggaaaatcagaacaaggggaatcaaacgccctatgagtactttaacggaaaagataattctcgggaatggcaggagttcaaggccagagtcgagacctccaggtttccacgtagtaaaaagcagcgcatcctcctgcagaaattcgacgaagagggttttaaggaacggaacctaaatgatacaagatacgtgaacaggttcctgtgccaatttgttgcggaccacatgctcctgactggcaaggggaaacgacgggtgttcgcctcaaacggacagattaccaatcttttgcgcggcttctggggtctgagaaaggtcagggctgagaacgatcggcatcacgcattagacgccgtggtagttgcttgtagcacagtggccatgcagcagaaaatcactcgatttgtcagatataaggagatgaatgcattcgatgggaaaaccatcgacaaggaaacaggcgaggtgctccatcaaaagacccactttccccagccttgggagttctttgcgcaggaagtcatgattcgcgtgttcggaaaaccagacggcaagccggaatttgaggaggccgatactcccgaaaaactgaggacgcttctggctgagaagttgtcctctcgtcctgaagccgttcacgagtacgtgacaccactcttcgtaagccgggcacccaacagaaaaatgtcagggcagggacatatggaaaccgtcaagagtgctaagaggctggacgagggtgtgtccgttctacgcgtgcctctgactcaactcaaactgaaggatcttgagaaaatggtcaatcgagaaagagagccaaagttgtatgaagccctgaaagcacggttagaggcccacaaggacgatcccgctaaagcgtttgccgaaccgttctacaagtatgacaaggcaggcaacaggacccaacaggtgaaagctgtacgcgtggagcaggttcagaagacaggggtctgggtgcgtaatcataacggaatagccgataatgccaccatggtgagagtcgacgtttttgagaaaggcgataagtactatctcgtgcctatctacagctggcaagtggctaaaggtattctgccagaccgggcagtagtccaggggaaggatgaagaggactggcagcttatcgatgactctttcaactttaagttctcactgcaccccaatgacctagtggaagttattactaaaaaggccaggatgttcggctactttgcgagttgccaccgcggaacaggcaacatcaatatacgaatccatgatctcgaccacaaaattgggaagaacggaatcctggagggcattggtgtgaaaacggctttgagcttccagaagtatcagatcgatgagctggggaaggaaataagaccttgtcggcttaaaaagaggcccccagtccgctga

SEQ ID NO: 2716 - RNA, 3249 nt, synthetic construct
  misc_feature 1..3249: note = Cas9 variant
  source 1..3249: mol_type = other RNA
atggccgctttcaagcccaaccctatgaattacatcctgggcctcgacattgggatagcaagcgtgggatgggccatcgtcgagattgatgaagaggaaaacccaatcagacttattgacctgggtgttagggtgtttgagcgggcggaagtaccgaaaaccggcgattccttggctgccgcacgccgattagcccgttctgtgagaaggctgacacggcgcagagctcacaggctactccgggcacgccgactgcttaagagagagggggtcctgcaggccgctgacttcgatgagaatggattgatcaaatcactccccaacactccttggcaactgagggccgcggcactggaccggaagctcacgccattagaatggagtgccgtgctgcttcatttgataaaacaccgtggctatctgagccagcgcaagaatgagggtgaaaccgctgataaggagctaggggccctcctgaaaggagttgcagacaacacacatgcccttcagactggcgattttagaacccccgctgagctggcgttgaataagttcgaaaaagagtccggccacatcaggaaccagcgaggggactactctcatacatttaatcggaaggatctccaagccgaactgaacttactgttcgagaaacagaaggaatttggaaatcctcacgtgtcggacggtctcaaggagggcattgagacccttctgatgactcagcgcccagcattgtcaggggatgctgtccagaaaatgctaggacactgcacattcgaacccaccgagcctaaggccgctaaaaacacgtatactgccgaaagatttgtgtggctgaccaagctcaataacctgaggatccttgagcaaggcagcgaacggccactgacagacactgagcgcgcaaccttgatggacgagccgtacagaaaaagtaagctcacatatgcccaggctaggaaactgttagatctggacgataccgcgttctttaagggtctacgttacgggaaggacaatgcagaagcctccacgctcatggagatgaaggcttatcatgccatttctcgggcactggaaaaagagggacttaaagataagaaaagccccttgaacctgtcccctgaactccaggacgagatcggcactgccttctcactgtttaagacagatgaggacataaccggccgacttaaggatagagtacagccagaaattctggaggctttgctcaaacacatcagtttcgacaagttcgttcaaattagcctgaaagccttaaggcgcatcgtgcccctgatggaacaggggaaccggtacgatgaggcatgtactgagatctacggagaccattatggtaagaaaaatacagaagagaagatttacctacctccaatacccgcggacgaaatcagaaacccggtcgtgctcagggctctgtctcaggcccgcaaggtgattaatggcgtcgttcgacggtatgggtcccctgcacgtatccacatagagaccgccagagaagtgggaaaatcatttaaggataggaaagagattgagaagcgccaagaagagaaccggaaagacagagaaaagagcgctgccaagttcagggagtactttcccaatttcgtaggcgaaccaaaaagtaaggatatccttaaattgcgactgtatgagcagcagcacggtaagtgcctctactctgggaaagagatcaacctgggccgcttaaatgaaaagggatatgtggagattgaccatgcactgcctttttcccggacgtgggatgacagcttcaacaataaagtccttgctttgggctcggaaaaccagaataaggggaaccaaaccccctacgagtactttaatggaaaggataactctagagaatggcaggagttcaaagccagggtggagacatcccgttttccacgctcaaagaaacagcggatcctcctgcagaagttcgacgaagatggttttaaagagagaaatctaaacgacactaggtatattaaccgattcctgtgtcaatttgttgcggatcacatgctcctgaccggcaaggggaagcggcgcgtgttcgccagtaatggacagataacaaaccttttgagaggcttctggggtctgaggaaagtccgggctgaaaatgaccgacatcacgcattagatgccgtggtagttgcttgcagcactatcgccatgcagcagaagattaccagatttgtgcgctacaaagagatgaacgcattcgacgggaagacaatcgacaaagagaccggcgaagtcctccatcaaaaggcgcactttccccagccttgggagttctttgcccaggaagtgatgatcagggtcttcggaaagccagatggcaaaccggagtttgaagaggctgacactcccgagaagctgcgtacgcttctggccgaaaaattgtcctctcggcctgaggcagtgcacaagtatgttacaccactcttcattagcagagctcccaataggaaaatgtcagggcagggacatatggaaaccgtgaagagtgccaagcgcctggatgagggtatatccgtactacgagtccctctgactcaactcaaactgaaggaccttgagaaaatggtgaacagagaacgggagccaaagttgtacgaagcactgaaagccaggttagaggctcacaaggatgaccccgcgaaagcctttgcagaaccgttctataagtacgataaggctggcaatcgcacccagcaggttaaagccgtgcgtgtcgagcaagtgcagaagacaggggtatgggtgcataaccacaatggaatcgccgacaacgctaccattgttagagtcgatgtgtttgaaaaaggcggtaagtattacctcgtgcctatctacagctggcaggtcgcaaaagggattctgccagaccgggccgttgtgcagggcaaggatgaggaggactggactgtgatggatgactctttcgaatttaagttcgtactttatgcgaatgacctgatcaaactaacagctaagaaaaacgagttcctcggatactttgtctcactgaatagggccacgggcgcaatagatatccgcacccacgacactgatagtacaaaggggaaaaacggaattttccaaagcgtgggcgttaagaccgccttgtcctttcagaagtatcagatcgacgaactgggtaaagagattcgaccctgtagattaaagaaacggcctcccgtgaggtga

SEQ ID NO: 2717 - RNA, 3249 nt, synthetic construct
  misc_feature 1..3249: note = Cas9 variant
  source 1..3249: mol_type = other RNA
atggccgctttcaagcccaacagcatcaattacattctgggcctcgacatagggatcgcatccgtgggatgggccatggtcgagattgataaagaagagaaccctatcagacttattgacctgggtgttagggtgtttgaacgggcggaggtaccaaagaccggcgattctttggctgccgcacgccgattagcccgttcagtgagaaggctgacacggcgcagagctcacaggctactccggactcgccgactgcttaaaagagaaggggtcctgcaggcagccaatttcgacaagaacggattgatcaaaagtctcccgaatacgctgtggcaactgagggctgccgcgctcgatcggaagttaactcccctggagtggagcgcagtgcttttgcatctgataaagcaccgtggctatctatcccagcgcaaaaacgagggtgaaacagccgacaaggagctcggggctctgcttaaaggagttgccggcaatgcacatgctctgcagactggcgattttagaacccctgccgaattggcgctcaacaagttcgagaaagagtctgggcacatcaggaatcagcggggagactactcgcatacattttcacgaaaggatctgcaagccgaattaaacctcctgttcgagaagcagaaagaatttggtaatccacacattagcggcgggcttaaggagggaatcgaaaccctgttgatgactcagcgccccgcactaagtggcgacgctgtgcagaaaatgctgggtcactgcacattcgagcctaccgagccaaaggccgctaaaaacacgtatactaccgaaagatttatttggctcacaaagctgaataaccttaggatcctggagcaagggtccgaacggcccttgactgataccgagcgcgccacactcatggacgaaccttacagaaaatctaagctgacctatgcacaggccaggaagttactgagcctagaggatacggctttctttaaaggactccgttacggcaaggacaatgcggaggcatccactctgatggaaatgaaagcctatcatacaatatcacgggctcttgagaaggaaggcttgaaagacaagaagagtccactgaacctcagcccggagctgcaggatgaaattgggaccgccttctctctttttaaaactgacgaggatatcacaggacgactgaaggacaggattcagcccgagatcttggaagcactcctgaaacacatctccttcgataagttcgtccaaatttcattaaaagccctgagacgcatagtgcctctaatggagcagggtaagcggtacgacgaggcttgtgccgaaatctacggcgatcattatgggaagaaaaacaccgaggaaaagatttacctcccacccatccctgcagacgagataagaaatccagtagttctgagggcgcttagccaggctcgcaaagtgattaacggagtcgtgcgacggtatggcagtcccgcccgtatccacatcgaaacggcaagagaggtgggtaagtcttttaaagataggaaggaaattgagaagcgccaagaggaaaatcggaaagacagagagaaggccgctgccaaattcagggaatactttccgaacttcgtcggggagcctaagtccaaagatatcttgaagctgcgactctatgaacagcagcacggcaaatgcctgtacagcggaaaggagattaatttagttcgcctgaacgagaagggctatgtggaaatagaccatgcacttcccttttcgcggacctgggacgattctttcaataacaaagtattggtgctcgggtccgagaatcagaacaagggaaatcaaacaccatacgaatactttaacggtaaagacaattcaagagagtggcaggagttcaaggctagggtcgaaaccagtcgttttcctcgcagcaaaaagcagcggatcctgctacagaagttcgatgaggacggctttaaagaaagaaacctgaatgataccaggtatgtgaaccgattcctctgtcaatttgttgccgaccacattctgcttacagggaagggaaaacggcgcgtgttcgcgtccaacggccagatcactaatttgctgagaggtttctgggggttaaggaaggtccgggccgagaacgatcgacatcacgctctcgacgcagtggtagttgcctgctctaccgtggctatgcagcagaaaatcacaagatttgtccgctacaaggaaatgaatgccttcgatggcaagaccattgacaaagagactggagaggtgctgcatcaaaagacgcactttccccagccatgggagttctttgcacaggaagtcatgataagggtgttcggcaaacccgatgggaagcctgaatttgaggaagcggacacacttgagaaactgcgtaccttgctcgccgagaagctgagctcacggccagaagctgttcacgagtatgtgactccgctattcgtaagtagagcccccaacaggaagatgtccggacagggtcatatggaaaccgtcaaaagcgcaaagcgcctggatgagggcgtgtctgttctccgagtgcctctgacacaacttaaattgaaggacctggagaaaatggtcaatagagaacgggagccaaagttatacgaagctctcaaagccaggctggaggcacacaaggacgatcccgccaaggcttttgcggaacctttctataaatacgacaaggccgggaaccgcacccaacaggtgaaagcagtacgtgtggagcaggttcagaagactggagtctgggtgagaaatcataacggcatcgctgataatgccacaatggtgcgggtcgacgtttttgaaaaaggtgataagtattaccttgtgccaatttactcatggcaagtggccaaggggatcctgcccgacagggctgtagtccagggcaaagatgaggaggactggcagctaattgatgacagtttcaactttaagttcagcctccacccgaatgatctggtggaagttatcacgaaaaaggcacgcatgttcggatattttgcctcctgtcaccgaggcaccgggaacataaatatccggattcatgacttggatcacaaaatcggaaagaacggcattctggagggtatcggggtgaagactgcgttatctttccagaaataccagatagacgaactcggaaaggagattagaccttgcaggctgaaaaagcgcccacccgtcagatga

SEQ ID NO: 2718 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatagggatcgcaagcgtgggatgggccatggtcgagattgatgaagaggaaaacccaatcagacttattgacctgggtgttagggtgtttgagcgggcggaagtaccgaaaaccggcgattccttggctatggtgcgccgattagcccgttctgtcagaaggctgacacggcgcagagcacacaggctactccgggcccgccgactgcttaagagagagggggtgctgcaggctgcagacttcgatgagaatggattgatcaaatcactccccaacactccttggcaactgagggccgctgccctggaccggaagctcacgccattagaatggagtgcggttctgcttcatttgataaaacaccgtggctatctgagccagcgcaagaatgagggtgaaaccgcagataaggagctaggggccctcctgaaaggagtggctgacaacgcccatgcacttcagacaggcgattttagaactcccgctgagctggccttgaataagttcgaaaaagagtccggccacatcaggaaccagcgaggggactactctcataccttttcgcggaaggatctccaagcggaactgattttactgttcgagaaacagaaggaatttggaaatcctcacatctcaggtggcctcaaggaggggattgagacacttctgatgacccagcgcccagccttgagcggagacgcagtccagaaaatgctaggccactgcactttcgaacccgctgagcctaaggccgctaaaaacacatataccgccgaaagatttatctggctgacgaagctcaataacctgaggatacttgagcaaggtagtgaacggccactgactgataccgagcgcgcaacattgatggacgagccgtacagaaaatccaagctcacttatgcccaggctaggaaactgttagggctggaagacaccgcgttctttaagggactacgttacggcaaggataatgcagaggcctctacactcatggaaatgaaggcttatcatgccattagccgggcactggagaaagaaggccttaaagacaagaaatcccccttgaacctgtcacctgagctccaggatgagatcgggaccgccttcagtctgtttaagacggacgaagatattactggacgacttaaggacagaatccagccagagatcctggaggctttgctcaaacacattagcttcgataagttcgtgcaaatatctctgaaagccttaaggcgcatcgtacccctgatggaacagggtaagcggtacgacgaggcatgtgcggaaatttacggcgatcattatgggaaaaagaatacagaggaaaagatctacctacctccaatacccgctgacgagattagaaacccggttgtgctcagggccctgtcccaggcacgcaaagtcatcaacggagtggtgcgacggtatggcagccctgcccgtatccacattgaaaccgctagagaggtcggtaagtcatttaaagataggaaggagatcgaaaaacgccaagaggaaaatcggaaggacagagagaaggccgcagctaaattcagggaatactttcccaacttcgttggggagccaaagagtaaagacattcttaagttgcgactgtatgagcagcagcacggcaaatgcctctactctggaaaggaaataaatctgggccgcttaaacgagaaagggtatgtggaaatcgatcatgccctgcctttttcccggacttgggacgatagcttcaataacaaggtacttgtgttgggatcggagaatcagaacaagggtaatcaaacaccctacgaatactttaacggcaaagacaattctagagagtggcaggagttcaaggcgagggtcgaaacctcccgttttccacgcagtaaaaagcagcggattctcctgcagaaattcgatgaggacgggtttaaggaaagaaacctaaatgatacgaggtatgtgaaccgattcctgtgtcaatttgttgccgaccggatgcgcctcaccggaaagggcaaaaagagagtgttcgcttcaaatggtcagatcacaaacctgcttagggggttctggggcttgcggaaagtccgagcagagaacgatagacaccatgccctggacgctgtggtagttgcctgcagcactgtggcaatgcagcagaagatcacccgctttgtcaggtacaaagagatgaatgcgttcgatggaaagacaattgacaaggaaactggcgaggtgttacaccagaaaacccattttccccagccttgggagttctttgcccaggaagtcatgatacgtgtgttcgggaagccagatggaaaaccggaatttgaggaggctgacacacccgaaaagctccggaccctgcttgccgagaaactgtcctctagacctgaagcagttcacgagtatgtgactccattgttcgtaagcagggctcccaaccgcaagatgtcaggtcagggccacatggaaacggtcaagagtgccaaacgactcgacgagggggtgtccgttctgagagtgcctctaacacaactgaagctcaaagatctggagaagatggtcaatcgggaaagggagccaaaactttacgaagcattgaaggcccgcctggaggctcataaagacgatcccgcgaaggcctttgcagaaccgttctataagtacgacaaagctggaaaccgtacccaacaggtgaaggccgtaagagtggagcaagttcagaaaactggcgtctgggtgcggaatcacaacggtatcgccgataatgctaccatggtgagggtcgacgtttttgagaagggggataaatattacttagtgcctatttacagctggcaagtggcaaagggcatcctcccagaccgcgccgtagtccagggaaaggatgaagaggactggcagctgattgatgactctttcaactttaaattctcacttcatcccaatgatctggtggaagttatcacaaagaaagcgcgaatgttcggctattttgctagttgtcacagagggaccggaaacataaatatccggattcacgacctagaccataagatcggcaaaaacggtattctcgaggggatcggagtgaagactgccctgagcttccagaagtaccagatagatgagttgggcaaagaaattaggccttgccgcctgaagaaaagacccccagtcaggtga

SEQ ID NO: 2719 - RNA, 3249 nt, synthetic construct
  misc_feature 1..3249: note = Cas9 variant
  source 1..3249: mol_type = other RNA
atgagagtgctgggcctcgacgccgggatcgctagccttggatgggcactgattgagatagaagagtccaacaggggtgaattgtctcagggcaccatcattggggccggaacatggatgttcgatgcgcccgaggaaaagactcaagctggcgccaaattaaagtcagagcagcggcgcacgtttcgaggtcagcgtagagtcgttaggcggcgcagacagaggatgaatgaggtgcggcgcatcctgcacagtcatgggctactccctagctccgaccgagatgcactgaaacaaccaggacttgacccgtggagaattagggccgaagctctggatcggttgctcggccccgtagagctggcagtggccctgggccacatcgctcgtcatcgcgggttcaagtctaactcgaaaggagccaagaccaatgaccctgcggatgacacatcaaagatgaaaagagcagtcaacgaaactagggagaagctcgcccggtttggtagcgctgccaaaatgttagtggaggatgaaagtttcgttctgcgacagaccccaacaaagaatggcgcatccgagatagtgcgcagatttaggaaccgggaaggggactactctcgcagccttttgagagatgacctggctgccgagatgagggcgctattcaccgcccaggcacgttttcagtccgctatcgccactgctgatctccaaacagccttcaccaaagcagcctttttccagcggcccctgcaggactcagaaaaacttgtcggaccttgcccatttgaggtggacgagaagcgagctcccaagagaggctatagtttcgaactgtttaggttcttgagccgcctcaatcacgtaacgctgcgggatggtaagcaggagagaactttaaccagggacgaactggcgctcgcagccgctgatttcggggccgcagccaaagtttcttttacagcccttcgcaagaaactgaagttgcctgagactaccgtgttcgtcggagtgaaagctgacgaagagtccaagctagatgtggtcgcacgatcaggcaaggcggctgagggcacagcccggctgcgtagcgttattgtggacgcactcggggaactggcctggggagcccttctgtgtagtccagagaaattggataagatcgctgaagtaatttcttttagatccgacatcggtaggataagcgagggcctcgcacaagctgggtgcaacgccccgctggtggatgcgttaaccgccgctgcatcggacggacgcttcgatccctttacgggcgccggtcatatttcttccaaagctgcccggaatatcctgtcagggctaagacagggcatgacttacgacaaggcatgttgcgcggccgactatgatcacacagctagtagggaacgaggagccttcgacgtcggcgggcacggacgcgaggcactcaaacggattctgcaggaggaaagaatcagcagggagcttgtgggttcccctaccgctcgtaaggccttgatcgaatctattaagcaagttaaagcaatagtggagcgctacggcgtcccagatcggatccatgtggagctggccagagacgtaggaaagagcattgaagagagggaagagatcactcgagggatagaaaaacggaaccgccagaaggataaactcagaggcctgtttgagaaggaggttggtaggccccctcaggacggggctcggggcaaggaagaacttctgcgattcgaattgtggtcagagcagatgggaagatgtctctatacagatgactacattagtccatcccaactggtggcgaccgatgacgccgtccaggtggatcacatcttaccctggagccgctttgcagacgattcttatgctaataaaacgctgtgcatggccaaggccaaccaggacaaaaagggcaggaccccgtacgaatggttcaaagctgagaagacagacactgagtgggatgcatttatcgtccgtgtggaagccctagcggacatgaaggggttcaaaaagcggaattacaaactcagaaacgctgaggaagccgcagccaagtttaggaatcgcaacctgaacgatacccgatgggcttgtagacttttggcagaggccctgaaacagctctatcctaagggagaaaaagacaaggatggtaaggagcggaggcgcgttttctcacgtcccggcgcgctgacagacagattacggagggcttgggggctgcaatggatgaaaaagagtactaaaggagatcgcattccagacgatcgacatcacgcccttgacgcaatcgtgattgccgctaccacagagagcttgctccagagagccacccgggaagtacaggagatagaagataagggcctgcactacgacctagtcaaaaatgtgactcctccctggccaggtttcagggagcaggcagttgaggctgtggaaaaggtctttgtggcccgcgcggagagaaggcgggcccgtgggaaggcacatgatgctacgatccgccacattgccgtacgagaaggcgagcaaagagtgtatgaaaggcggaaagttgctgagctgaagctcgcagacctggaccgcgtcaaagatgccgagagaaacgccaggcttatcgaaaagttgcggaattggatcgaggctggatcccccaaagacgatcctccactgtctccgaagggcgaccccattttcaaggtgcgattagtgacaaaatcgaaggtcaacatagcgctcgataccgggaatcctaaaagaccaggaactgttgaccgcggcgaaatggcaagggtggatgtgtttcggaaggccagcaaaaagggtaagtacgagtattacctggtacccatctatcctcatgacattgctaccatgaaaacaccacccatccgtgccgtccaggcatacaagccggaagatgagtggcctgagatggactcctcatacgagttctgctggagtcttgtgccaatgacctatctgcaggttatttctagcaaaggggagatctttgaaggatactatagaggcatgaacaggtccgtgggtgccatacagttgtcagctcacagcaattcttccgatgtcgtgcaaggcatcggggcgcgcactctcacagagttcaagaaatttaacgttgaccggttcggacgaaagcatgaagtggagagagagctgaggacgtggcgcggcgaaacctggcgggggaaagcctacatttga

SEQ ID NO: 2720 - RNA, 3255 nt, synthetic construct
  misc_feature 1..3255: note = Cas9 variant
  source 1..3255: mol_type = other RNA
atgaagaacaccctgtacggcatcgggctcgacattggagtggccagcgtcggttgggctgttgtgggccttaatgggacaggagagcccgtaggcctgcacagattgggtgtgaggatattcgataaagcagaacagcctaagactggggagtccttagccgcgccacggcgcatggctcgaggaatgcgtagaaggctgcggcgcaaagccctaagaagggcagacgtctatgccctcctggaacggtctggcctttcaacgcgcgaggctctggcacatatgtttgaagccggcgggttggaggatatctacgctctccgaaccagagccctggacgagccggtgggaaaggcggagttcagtaggattctgctccacttagcacaacggcgtggttttaaaagcaaccgcagaacagcctccgatggcgaagacgggaggctgcttgctgccgttaatgaaaaccggcgacgcatggcacagggaggctggagaactgtgggtgagatgttgtataggcatgaggctttcgccctgcacaagcggaataaggcggatgaatacctatctaccgtcgggcgcgacatggtggccgaggaagcatcgctcctgtttcagagacagagggagcttggatgcgcttgggccacacccgaactgcaagctgagtatttgtcaatcctcctgcgtcagcggagcttcgatgagggccctggcgggaacagtccatacggaggtaatcaggtagagaaaatggttggccgatgtacctttgaacccgacgaacctagagccgcaaaggccgcttattccttcgagtacttttctttactgcagaaaattaaccatatcaggctcgtggaaaatggggagactcgcccacttacacaacagcagcggcagcaactgttgagcctagcgcacaagacccccgatgtctccctggcaagaataaggaaagagctcgccctgcctgaaacggtgcagttcaacggagtgcgctgccgagctaatgagactcttgaagagtcagaaaagaaggagaaatttgcctgtctgccagcataccacaagatgcggaaagccttggacggcgtcgttaagggtcgtatcagtagcctctctatttcccagagagatgctgccgcaaccgcgctgtcattatataaaaacgaggacacactgagggctaagctaactgaagccgggttccaagcaccggagatcgacgccctcgctggcctgaccggatttagcaaattcggccatcttagtttgaaggcctgccgcaagctgattccccacctcgaacaggggctgacatacgatcaggcatgttctgctgccggatatgacttcaaaggtcatggcgcgggggagcgggcctttacccttcctgctgcagccccagagatggaacagatcacgtcccccgtggtaagaagggctgtggcccaaactataaaggtcgtgaatggaattatccgagagatggatgcaagccctgcgtgggttcgcattgaactggcccgggagttgtcgaaaacattcggcgaaagacaggagatggacaggtctatgcgtgagaacgctgcccagaatgaacgcctcatgcaggagctgcgggatacctttcacttactgtccccaactggtcaagacctagtgaagtacagactctggaaagaacaggatggggtctgcgcatattcactgaggcgacttgacgtggagcggttgttcgaacccggctacgtagatgttgaccacatcgtgccgtatagtctgagctttgatgaccgcagatccaacaaggtcctcgtgctgtctagcgagaacaggcagaagggaaatcggttacctctgcagtaccttcaaggcaaacgaagagaggacttcatcgtctggacaaactcaagtgtgcgcgattacaggaagcgtcagaatttgctccgggaaaaactgtccggggacgaggctgaaggatttagacagaggaacctacaggatacccaacatatggcccgcttcctgtataattacattagcgaccacctcgcatttgcccagtctgaggctctgggtaagaaacgagttttcgcggtgtcaggcgccgtaacgagtcatcttagaaagcggtgggggttgagcaaggtcagggcagatggagacctgcaccatgctttagatgccgccgtgatagcttgtaccacagacggcatgatccgccgtatttccggttattacgggcacatcgaaggcgagtatctccaggatgcagacggagccggctctcaacacgcgagaactaaagagcggtttcccgctccatggcctaggttccgcgatgaactgatagttcgactttcggagcagcccggggaacatctgttggacattaacccagagttttactgcgagtatggaaccgaacacatcagacccgtgttcgtcagccggatgcctaggcgcaaggtgacaggcccaggtcataaagagactatcaagggggccgcagccgctgatgaaggactcctgaccgtaagaaaagcactaacagagctgaagctcgacaaggacggcgaaattaaagattactacatgccgtcctcagacaccctgctttatgaggccttgaaggcgcagctgaggcggttcggtggcgatagtaaaaaggcttttgccgagcccttctacaaacctaaggcagacgggactccaggacccttagtgcgtaaagttaagacgacagaaaaggccaccctcactgtccctgtgcacggcggggctgcctctaatgataccatggtgcgcgtcgacgtttttctggtgccaggagatggctattactgggtgcccgtatatacagcagacacccttaaaccggagctgcctaaccgagctgtcgtgcagggtaagccatacagcgaatggaaagagatgagagaagaggatttcatcttttccctatatcccaatgacctcgtttacgtggagcacaagtcagggctgaaattcactttgcaaaacgccgatagcacactggaaaagacgaggacccagacttctgcgtttgtctacttcgtgggaggctccattagtacagccagcataaccatccggacacatgacaatgcatatggtattccttctttaggcgttaagactctcaaaacctttcacaagtaccaggtggatgtactggggaacgtcttccccgtgcataaagagacgcgccagaagtttagatga

SEQ ID NO: 2721 - RNA, 3255 nt, synthetic construct
  misc_feature 1..3255: note = Cas9 variant
  source 1..3255: mol_type = other RNA
atgaagaacaccctgtacggcatcgggctcgacattggagtggccagcgtcggttgggctgttgtgggccttaatgggacaggagagcccgtaggcctgcacagattgggtgtgaggatattcgataaagcagaacagcctaagactggggagtccttagccgcgccacggcgcatggctcgaggaatgcgtagaaggctgcggcgcaaagccctaagaagggcagacgtctatgccctcctggaacggtctggcctttcaacgcgcgaggctctggcacaaatgtttgaagccggcgggttggaggatatctacgctctccgaaccagagccctggacgagccggtgggaaaggcggagttcagtaggattctgctccatttagcacagcggcgtggttttaaaagcaaccgcagaacagcctccgatggcgaagacgggaggctgcttgctgccgttaatgaaaaccggcgacgcatggcacagggaggctggagaactgtgggtgagatgttgtataggcacgaggctttcgccctgcataagcggaataaggcggatgactacctatctaccgtcgggcgcgatatggtggccgaagaggcatcgctcctgtttcagagacaaagggaacttggatgcgcttgggccacacccgagctgcaggctgaatatttgtcaatcctcctgcgtcagcggagcttcgacgagggccctggcggggatagtccatacggaggtaaccaggtagagaaaatggttggccgatgtacctttgaacccgacgagcctagagccgcaaaggccgcttattccttcgaatacttttctttactgcagaaaattaatcacatcaggctcgcggagaacggggaaactcgcccacttacacaaccccagcggcagcaactgttgagcctagcacataagacccctgatatgtccctggccagaataaggaaagagctcgctctgccagagacggtgcagttcaatggagtccgctgccgagccaacgaaactcttgaggaatcagagaagaaggaaaaatttgcatgtctgccggcctaccacaagatgcggaaggctttgggcggtgtggtgaaagggcgtatcagtagcctctctatttcccagagagacgccgcagcgaccgctctgtcattatataaaaatgaggacacactgagggccaagctaactgaggcaggcttccaagcccccgaaatcgatgctctcgccggactgaccggctttagcaaattcgggcaccttagtttgaaggcatgccgcaagctgattcctcatctcgagcagggactgacatacgaccaggcttgttctgccgcgggttatgatttcaaaggccacggggccggagaacgggcttttacccttccagcagccgctcccgagatggagcagatcacgtcccctgtcgttagaagggccgtggcacaaactataaaggtagtgaacggcattatccgagaaatggacgcgagcccagcctgggtccgcattgagctggctcgggaattgtcgaaaacattcggtgagagacaggaaatggataggtctatgcgtgagaatgccgcaaagaacgagcgcctcatgcaggaactgcgggacacctttcatttactgtcccccactgggcaggatctagtgaaatacagactctggaaggagcaagacggcgtttgcgcttattcactgcagaggcttgatgtggaacagttgttcgagccgggatacgtcgacgtggatcacatcgtaccttatagtctgagctttgacgaccgacggtccaataaggttctcgtgctgtctagcgaaaaccgccagaaaggcaacagattacccctgcaataccttcaggggaagaggcgggaggatttcatcgtctggacaaattcaagtgtgcacgactaccgaaaaagacagaacttgctccgcgagaagctgtccgatgacgaagccgagggatttaggcagcgtaatctacaagatacccagcatatggcacggttcctgtataactacattagcgaccacctcgcctttgctcagtctgaagcgctgggtaaaaagagagtcttcgccgtgtcaggcgcagttacgagtcatcttaggaagcgctgggggttgagcaaagtgcgagctgatggagacctgcaccatgccttagatgccgctgtagtcgcatgtaccacagacggcatgataagacggatctccggttattacgggcacattgagggcgaatattttcaagatgccgacggagcgggctctcagcacgctaggactaaggagcgcttcccagccccttggccccgttttagagatgagctcatcgtgcggctgtcggaacagccaggggagccccttctggacataaatcctgcattctactgcgaatatggaaccgagcatattaggccagttttcgtgagccgcatgccgcgaagaaaagtcacaggcccctcccacaaggagactgtgaaaggtgccgctgcagccgacgaagggttgctcaccgtacggaaggcgctgacagagctaaagctggataaagacggagaaatcaaggattactacatgccttcaagtgacaccctcctgtatgaggctcttaaagcccagttgaggcgctttggcggtgatggcaagaaagcattcgccgaaccattttacaagcccaaagctgacgggactcctggaccactggtgagaaaggttaagacgacagagaaagccaccttaactgtccccgtgcatggcggggcagcttctaacgataccatggtgaggatcgacgtcttctttatgccgggagatggctattactgggttcctctctatgtggccgacacactgaagccagagcttcccaatcgggcggtggtagcccacaaaccttacagcgaatggcaagagatgcgtgaagaggatttcgtcttttccctgtatcccaacgacctagtgtacgttgaacacaagtcagagctcaaattcaccgtgcagaatgcagatagcactctggagaagacacgcacgcaggcttctgcctttgtctacttcgtgtccggtgggattagtggaggcaccatcactgttcgaacacatgacaacagctatggtattccatctttgggcctgaagaccttaaaatccctctgtaagtaccaggtggacgtactggggaatgtctttcctgtgcacaaagaaacaagacaaaagttcaggtga

SEQ ID NO: 2722 - RNA, 3255 nt, synthetic construct
  misc_feature 1..3255: note = Cas9 variant
  source 1..3255: mol_type = other RNA
atgaagaacaccctgtacggcatcgggctcgacattggagtggccagcgtcggttgggctgttgtgggccttaatgggacaggagagcccgtaggcctgcacagattgggtgtgaggatattcgataaagcagaacagcctaagactggggagtccttagccgcgccacggcgcatggctcgaggaatgcgtagaaggctgcggcgcaaagccctaagaagggcagacgtctatgccctcctggaacggtctggcctttcaacgcgcgaggaactggctcaaatgtttgaggcaggcgggttggaggatatctacgccctccgaaccagagctctggacgaaccggtgggaaaggccgagttcagtaggattctgctccatttagcgcagcggcgtggttttaaaagcaaccgcagaacagcatccgatggcgaagacgggaggctgcttgccgctgttaatgagaaccggcgacgcatggcccagggaggctggagaactgtgggtgagatgttgtataggcacgaagcattcgctctgcataagcggaataaggccgatgactacctatctaccgtcgggcgcgatatggtggcggaggaagcctcgatcctctttgagagacagagggcaatgggatgctcatgggctgcccccgaactgcaagctgagtatcttagcattctgttgcgtcagcggagtttcgacgagggccctggcgggaactccccatacggaggtaatcaggtagagaaaatggttggccgatgtacatttgaacccgatgaacctagagccgcaaaggccgcttattctttcgagtactttagcctcctgcagaaattaaaccacatcaggctggcggaaaatggggagacccgcccactcactcaaccccagcggcagcagcttctgtccttggcacataagacacctgacatatcactagccagaatcaggaaagagctggctctcccagaaaccgtgcaattcaacggagtccgctgccgagccaatgagacgctggaagagagtgaaaagaaggagaaatttgcatgtcttccggcctaccacaagatgcggaaagctctggatggcgtggtgaagggtcgtattagctctttgtccatctcacagagagacgccgcagcgactgctctcagcctgtataaaaacgaggacaccttaagggccaagctgacagaagcagggttccaggcccccgagattgatgctctagccggcctcactggatttagtaaattcggccacctgtctcttaaggcatgccgcaagttgatccctcatctggaacaagggctcacctacgaccaggcttgtacagccgcgggatatgatttcaaaggtcacggcgccggggagcgggcttttaccctgccagcagccgctcccgagatggaacagataacgtcccctgtcgttagaagggccgtggcacagactattaaggtagtgaatggaatcattcgagagatggacgcgagcccagcctgggtccgcatcgaacttgctcgggagctgtcgaaaacattcggcgaaagacaagagatggataggtctatgcgtgagaacgccgcacagaatgaacgcttgatgcaggagctccgggacacctttcatctgttatcccccactggtcaggatctggtgaagtacagactatggaaagaacaagacggggtttgcgcttattcactcaggcgactggatgtggagcggcttttcgaaccgggctacgtcgacgtggatcacatcgtaccttatagtttgagctttgacgaccgcagatccaacaaggttctggtgctctctagcgagaacaggcagaagggaaatcggctgcccttacagtacctgcagggcaaacgaagagaggatttcattgtctggacaaactcaagtgtgcacgactaccgcaagaggcaaaatcttttgcgtgaaaaactctccggggatgaggccgaaggatttcggcagagaaacctgcaggacacccagcatatggcaaggttcctatataattacataagcgatcacctggcctttgctcaatctgaggcgctcggtaagaaacgcgtcttcgccgtgtcaggcgcagttacgagtcatctgcgaaagagatgggggcttagcaaggtgcgggctgacggagatttgcaccatgccctggacgccgctgtagtcgcatgtaccacagatggcatgatcaggcgcatttccggttattacgggcacatcgaaggcgagtatttacaggacgccgatggagcgggctctcagcacgctcgtactaaagagagatttccagccccttggccccggttcagggacgaactcatagtgcgcctgtcggagcaaccagcagaaccccttctggatattaaccctgagttttactgcgagtatgggaccgaacatatccgaccagttttcgtgagcagaatgccgcggaggaaggtcacaggacccggccacaaagagactatcaagggtgccgctgcagccgacgaagggttgctcaccgtgcgcaaagcgctgacagagctaaagctggacaaggatggagaaattaaagactactacatgccttcctcagataccctcctgtatgaggctcttaaggcccagttgagaaggttcggcggtgacggcaaaaaggcatttgccgagccattctacaaacccaaggctgatgggactcctggaccactggtacggaaagtgaagacgacagaaaaggccaccttaactgttcccgtccatggcggggcagctagtaatgacaccatggtgcgtgtggatgtctttctcgttccgggagacggctattactgggtgcctgtgtatacagccgataccctgaaaccagagcttcccaaccgcgcggtagtccagggtaagccttactctgaatggaaagagatgcgagaagaggacttcatctttagcctgtatcccaatgatctagtgtacgttgagcacaagtccgggctcaaattcactctgcagaacgccgactcaacattggaaaagacgagaacccaaactagcgcatttgcttacttcgtgtctggatccattagtacagccagcataaccatcaggacacacgataatgcttatggcattccatctctgggtgtcaagactttaaaaacctttcataagtaccaggtggacgttctcggcaacgtgttccctgtacacaaagagacgcggcagaagtttcgctga

SEQ ID NO: 2723 - RNA, 3255 nt, synthetic construct
  misc_feature 1..3255: note = Cas9 variant
  source 1..3255: mol_type = other RNA
atgagactgggcctcgacatcgggaccaacagcattggatggtggctttacggtacagagggcgggaggataactgaagtggtcgatggaggcgttcggatcttctccgacggtcgcgatccccagtctaaggcctcactggctgtggaccgacgtgcagccagaagtcaaaggcggcgcagagataggtatttgcggcgcaaagcggctttaatgaagcgaatggcccaggtagggctgatgcctgcagacccagccgaggctaaagtgctagaagtcctcaatccgtacgagctgagagcaagcggacttgatggccccctgcctttgacgcactttggcagggccctcttccatctgaaccagcggcgtgggtttaagtccaatcgcaaaaccgacagaggagataacgaatctggtaagattaaggacgctacagccaggctggatcaggcgatgatggcaaaaggcgcccggacttatggggagttcctccacatgcgacgcgctgccgcattagacccaaagtcggtgccctcagttagaaccaggctgacagtggctcggcgcgatgacgccgagaaagaagaggcgggatacgacttttatcctgatagaaagcatcttagcgaagagttcgacaaattgtgggccgcacaagctaggcacgccccagatgtcctgaccgaggacctacgtgatgaaatcgctactattatctttcatcagcggcccctcaagacacctgaggtgggcctgtgccttttcaccggtcagcacggggtaccagaacgagacaagagaataccgagtgcccaccccctgaatcagaggcgcatcttgatggagacggttaacaatctcaaagtggcagcccaaggagaaccttcccggccactgactagagaggagagggatcagattgtccatgctttagacaacaagaaacacaccaagtctctgagcggcatgacaatgaaactcaaggcgcttggcaaagtgatcaagctgcgccccgaacaggggtttactttggagaccgcaaatcgagatgccattgcttgtgaccctgtgcgggcctccctatcacatccagatcgtttcggagcaagatggagtacactggaaagcgccggtcagtgggacgtcgttcaaaggatccgcgctgtgcagtctgacgccgagcacgcagatctcgtaggctggctgatggacgtgcacgggcttgatcgggaccatgcggaagagaccgctaacgcacccctgccggagggatacggcagattgggtctcacggccactacaaggatactggccgctttagaagccgatgtcctgaattattccgcagctgtggccgcgtgcgggtggcaccattcagacggccgaaccggagaggttctagaaagcctcccttactacggcgagattctggaacgccacgtgatccccgggactggagatccaaacgacgatgacgtcaagcggtatggtagaattacaaatcctaccgtgcatatcggccttaaccagttgaggcgtctggtaaatcgcatcattacggtttacgggcggcccgatgagatagtggtcgagctcgccagagacctgaaacttagtgaagatcaaaagaaagacgtgcagagggacatcaagaaaaacaccgaggctgcaattcgacggggaaagaagctggaagagatgggcgtcccaaacacaggtgccaatcgcatggtgttgagactctgggaggatctgggggacgatgttatgactaggaactgtccctataccggcaaacggatctctgctggaatgttatttgacggctcctgcgatgtggaccacatactgccttacagccgaacactagatgactcgttcgccaatagaactctctgtctgaaggaagcaaaccgccagaaaaccgataagacaccatgggaggcgtggggcgaaaccgagcagtgggaagccattgctgccaatcttaaaaacttgccggcaaataaggcttggaggtttgcccccgacgcaatggagcgtttcgagggagaaaaggatttctctgcccgggctctggcggacactcaatatctctccagaatcgccagggcatacctggatgctttatatgacggtgacgatggcaaatcacacgtatgggtcgtgcctgggcgcctgacggagatgcttcgaagacattggggattgaacggcgttgccgccctcacagacagtgataagcagaccgtgaaagctaagaatcggactgaccacaggcatcacgcaatcgatgccgcggtcgtggctgccaccgaccgcggtctgattaaacgtatcgcagatatggccaagagagacgaatttaacggggctgaggaagtagcacggagcattccacccccttgggagggcttcagggatgacgtgtccgcccaggttacacgcataatcgtctctcaccgagcggatcatggaagaattgacccagctgcccggaaaagcggcagggactcaaccagtgggcagctacacaatgatactgcatacggaatcggccgcgacggtacagtggtgtccagaaaacccctggccagcctctctccgaacgatatcgtcgttacgaagaggggagctaatattcgggacgtggatctgcaaaaacatcttgcccgtgtgacccacgggttggacggcaaggcatttgaggctgccctgttagcgttcgccgcatcacctatactcccagataacactgacaatccctactttggtctgcgccgagtaagacttgaagagacactgcaggaaagtgctagggtcgaggtggccgatcaggaaggccggccttataaggcttacaagggggacagcaaccattgctatgagatctggtgtttgcccgatggaaaaattaagccacaggttgtgaccacatacgaggcacaccaatccggcgccgaaaagaaacctcaccccgccgctaagcgcctcatgagaatcttcaaaagggacatggtcatgctggagcgggatggggaaactattatcggatatgtgcagaagatgaaacagaacggctctatatttgttgcgccacataccgaggcaaatgccgacgctcgagacagagatccgaaggacgatttcaagctaatccagctgggtgccgggtcgctcgtgaaagcaaaggcccgcagggtaattgtcgacgagatgggacggctgcgtgatcctgggcccccactttga

SEQ ID NO: 2724 - RNA, 3258 nt, synthetic construct
  misc_feature 1..3258: note = Cas9 variant
  source 1..3258: mol_type = other RNA
atggacaagggcaccaacagcatcgggtgggccgctctgagactcgatgagcagggagaacccgtgggtattatagaggcaggcgtcaggatctacgccgacgggcgggaacctaaatccggaacatctcttgcggagggccgccgaattgctcgtggtatgtcaagaaggcgggatcgctataagagaaggcggcgcactgttctgaatacgttgaccgagttcgggttaatgccagccacaaaagcagcccgaaaggctctggtggcagaaactaacgacagaaggtttggagaggtagccagtaatgtgtacgctctacgggcccgtgcgctcgatgaaaaactgccgctttatcaactgggccgcgcattgttccacctcaaccagagaaggggctttaagagcaatcggaagaccgacaaacgagataacgaccaggggaagatcgcctccgctatttctcgcctgggaagaaaactggatgaggccggtgcaaggacactcggcgagttcttacataagcagcacgctgccgggaaatgggtccgggtgcgcccctcgagagttcctggagaagacgataaggaggaagacggctacggtttttatccagagaggtcattcctggaacgtgagtttgcggccatctgggaagcacaagctgccttctaccccgagcttttgaccgaggaacggcgagatcatctgcactgggtgatgtttttccagagacctctaaagaggccaactgtcgggaaatgcagctttcatcccgacgaggaccgcctccctaaggctcacccactgttccaggaatttcggcttataaaagagctgaatgaattggaggtggtacacagaggagataggcgcgagaagctcacaccggaccagcgagatcggctgttcaaccaattacgtacccagagaagttccgccttcacggcactgaggaaaactatcaaggcccccaccggcacacgctttaataaagaatctgacgctcgggataagctcaagggcgacgaggttgcggcagaaatgagccataaagatagattcgggcaggcctggattggaatgcctcttgctgagaggtgggccgtggtcgcaatgctgttggacactgaagatccactagaggtgaaggcctggctggaggaacgatatggttttgctgccgaccgcatcgatgcaattgcggctgccaaactccccaccggctacgggcggctgggagagacagcacttagagacatgctggacgaattgaggaacggcaccgtgaaggatgacgccggtcgtgatgtcgttctcacggagcgccaggctatggacaatatctggggcgataaccctgccctgcaacgggcagtgactgacgctagagagttaccaccctaccaggaagtactggggaggcgaataccgcctggaacaggcaaacccgccgatccatatgacgtgcagaaggggcggctaaccaatcctactgtccacattggactcaaccaactgaagcgcatcgtgaatgttcttatgagaaggcatggtcggcccgagcagattgcgttggaactggcccgagatctcaaactgaacgaggaacagaaggctgagaaaaacagagagatcgcacgcaatacaaaggccgctgaagccaggggcaaaaagctggaggaacttgggcacgcaaacaatggatacaaccgtgtgttgctcaagctgtgggaggacttaaatctgaaacagccagaaaaccgggagtgtatctattgcggcaaggcgattggtatagggaccctactctccaatcaagtcgatatcgaccacattctgccctggtcaaaaacgcttgatgacagtcaggccaacagaatcgtgtgtcatgtagagtgcaataggcagaagggcaaccacgctcctgccgaagttccacagtggcatgaccgctacgatgacatattggcacgagctgagagactgccgcggaataaagcctggaggttcggacgcgaagcaatgaagaagtttaaagatgacgagagcttcctcgcccgtcaactgaccgatacacagtatttatctagactggctcacgaataccttggcgcgttgtatcccgacgaggagcctgatgaatggggagggccagcccggaggaaccatgtgcgcgtcattcccggtcgaatgactgagatgctcagacggcagtggggcctgaatgcaatcatctccgaccacaaccagaagaataggaacgatcaccgccatcacgctattgacgccatcgtggtcggggtgaccacaagaaggctactgcaacggattgccactgttgctggaggccgtgaagcactcgccctggaggagaccataggtaaaatcgaacctccatggcccgggttttacgatgacgtgaaggcggctattgatcgcatcgtagtctcacataaaccggaccacggcagccttcctaagccaggaaaacccggccgaacagccgggcagttgcacaacgacaccgcatacggattcactggcgaggccagaaatggtgtgcctatcatggttcatagggtgccctttgctagtctgacggaaaaggatattccatctatacgggaccgccagttagcagatgccctctatgcggctatctccgggattagcggaaaggccgagctggcagccgctcttgccagattctcggaatctggcccttacaaaggtatcaggcacgtccgggtggtagagcccgtgtccgttattgcaatcaaggaccaggctggcaaagcctataaggggtacaaaggagatgcgaactatcgatacgacgtctgggagctgccaaatggcaagtggacacatgaagtggtgtcaatgtttaacgcccacagaccggattggcaaagtgagatacgcagcaagaatcctgcagctaggaaagtcttgtccctccatcagaacgacatggttgcctatgaacacccccaggatgggtacaccatcggacgggtggtgaagttctctgctggcggtcaaatggcactggccgggaatcgtgagggaggcgccctaaaaagcagagacgctgatccagaagacaggtttcgctacttctataagtcaggtggcgcgatgcgggacgtacagctgcgacaggtcagagtggatgagactgggagggttttcgaccccggacctcaggatcgcgagagtcggaacgcaagaaaacaaaatgacgccggctga

SEQ ID NO: 2725 - RNA, 3264 nt, synthetic construct
  misc_feature 1..3264: note = Cas9 variant
  source 1..3264: mol_type = other RNA
atgagatacaagatcggcctggacattgggataaccagcgtgggatgggccgtcatgaacctcgatatccccaggattgaggaccttggtgttcggatcttcgatcgcgctgaaaatcctcagacaggcgagtccctggcattgccacgacgtttagccagatctgcgaggcggcgcctgagaaggcggaaacaccgcctagaacgaattagaaggctcgtgatccgggaggggatactgactaaggaagaacttgacaaactgtttgaggaaaagcatgagatcgatgtatggcaattgcgtgtggaagctctcgaccgcaaactgaacaatgatgagctggccagagtcctcttacacctggcaaagaggcggggattcaagtcaaaccgaaaaagtgagcgcagcaataaggaaaactccacgatgcttaaacatattgaggaaaatagagccatcttgtcttcgtataggaccgtgggcgagatgattgttaaggacccgaaatttgctctgcacaagcggaacaagggtgaaaattacacaaacactatcgcacgcgatgacctagagagagagataaggctcattttctcaaaacagcgtgaatttgggaatatgagctgcaccgaggagttcgagaacgaatatatcacaatttgggccagtcagcggcccgtggcttccaaggatgacatcgagaaaaaggtcggattttgtaccttcgagcctaaagaaaagcgagccccaaaagcgacttacacatttcagtctttcatcgcatgggagcatattaataagctgagacttataagcccctccggcgccaggggcctgaccgatgaggaacgccggttgctctatgaacaggcttttcaaaagaacaaaatcacgtaccacgacattagaactctgttacatctgcctgacgatacctatttcaaggggatcgtgtacgacaggggagagtcacgcaaacagaatgagaacatacgatttctcgaacttgatgcctaccaccagattcggaaggcagtagacaaagtttatggtaagggcaagagtagctctttcctgccaatcgatttcgacacatttgggtacgctttgactctattcaaagatgacgccgatatccactcctatctgcgtaacgagtacgaacaaaatggaaagagaatgcccaacctcgcgaataaagtgtatgacaacgagctgattgaggaacttctgaatttgtcatttaccaagttcggccatctcagcctgaaagccttaaggagtatcctgccttacatggagcagggtgaagtctattcttccgcatgcgagcgcgctgggtacacatttaccggaccaaagaagaaacagaagacgatgctactcccgaacattccccctatagccaatccagtggtgatgcgggctctgactcaggccagaaaagtcgttaacgcaatcattaagaaatacggcagccccgtgtcgatccacatcgaacttgccagggatttgtctcaaacattcgacgagcgacgcaagaccaagaaagagcaggacgaaaatcggaagaaaaacgagactgctattagacagctgatggaatatggcctcacactgaatcctaccgggcacgatatagtaaagtttaaactttggtccgagcaaaacggaaggtgtgcgtactcactgcagccaatcgaaattgagcgtttgctcgagcccggttatgtggaagtcgaccatgtgatcccgtacagtcgcagcctggatgactcctatacgaataaggttttagtgctgacccgggagaacagagaaaaaggcaataggattcctgcagagtacctaggggtcggaacagaacgatggcagcagttcgagacttttgtgctcaccaacaagcaattctctaagaaaaagcgggatcgcctgcttagattgcactatgacgagaacgaagagacagaatttaaaaataggaacctgaatgatactcggtacatcagccgattctttgccaacttcataagagagcatctcaagttcgctgagtcagacgataaacagaaggtatacaccgttaatggccgcgtgacagcccacctgaggagtcgttgggaatttaacaagaatcgggaggaatccgacttacatcacgcagtcgatgccgtgatcgtcgcttgcaccactcccagcgacattgccaaagtgacggcattctatcagagaagggagcagaacaaggaactggcgaaaaagaaagagccacactttcctcaaccctggccacatttcgctgatgagcttcgcgcccgattgtctaagcaccccaaggaatcaatcaaagcactcaatctgggtaactacgacgaccagaagctagagagtctgcagcctgtttttgtgagcagaatgccaaaacggtccgtaacaggggccgctcatcaggaaaccctcaggcgctatgtcggcattgatgagcgttctggaaagatccaaactgtggttaaaaccaagctgtcggaaataaaacttgacgccagcggccacttcccgatgtacgggaaagagtccgatcccagaacatatgaggcaattcggcagaggttgctggaacacaataacgaccctaagaaggcttttcaggagccattatacaagcccaaaaagaatggagaacctggtccagtgatccgcaccgtcaaaattatcgatactaagaaccaggtgatacccctcaatgacggcaagacagtagcctataactcaaacatcgtgcgagttgatgtcttcgagaaagacgggaagtactactgtgtgccggtgtatacgatggatattatgaaaggaatcctgcctaataaggcgattgaaccaaacaaaccctacagtgagtggaaggagatgaccgaagactatacttttagattctctctttaccctaatgatctgatccggatagagttgcccagggaaaagacagtcaaaaccgccgctggcgaggagattaacgttaaggacgtgtttgtgtattacaaaacaatcgatagcgcaaatggtgggctcgaactgatctcccatgaccaccgcttctcactaagaggcgtaggaagcaggactctgaagcggtttgagaaatatcaagtcgacgtgctcggcaacatttacaaggttcgtggggaaaagcgcgtgggactggcctcttccgctcatagtaaaccaggtaagaccatccgacctcttcagagcacgagagattga

SEQ ID NO: 2726 - RNA, 3264 nt, synthetic construct
  misc_feature 1..3264: note = Cas9 variant
  source 1..3264: mol_type = other RNA
atgctgagaatgaagtacgccatcggcctcgacattgggatagctagcgtgggatatgcagtccttgccctggatcacgaggaaaacccctggggtatcattaggttgggctcccggatcttcgacgttgcggagaatcctaaagatggggcttctttagccctgccacgccgagaagcacgttcagtgagaaggcggctacgcagacatcaccataggctcgagcggattaagaacctgcttatcaataccgaatttataacaaaagacgagctgttgcacctctacgatggaaacctgagtgacgtatatgagctgcgcgtgaaggccctcgattacagcgtcactaatgctgaattaacgcgaatcctgcttcatttggcacagagaaggggcttcaaatccaaccggaagtctgacgccaatgataaggaggctggtcaactgctagaagccgtgtcggcgaacgcaaaacgtatgcaggagaatcactatcgcaccgttggggagatgttttacaaggacgatctcttctcaaaatataagagaaacaaaggaggcacatacctgactaccgtgcacagggacatgattgccgctgaagcccggacaatccttgagaagcagtttgcactgggcaataacatttgcacccaggatttcatcgacaagtacttgagcatactcctgagtcaacgacagtttgacgaagggccgggagagccctccccttatgctggtaatcagattgccaacatgatcggcaaatgtactttcgaaccaaatgagtaccgcgcggccaaggcatcttatagctttgagagattcaacttactgcagaaagtcaaccatctcaggcttctgttggaagggaagtccattgctctagataatgagcaacggaaaaagatcatcgccctggctcacgacaaagccgatctccgctactcacatattagaaaggcactgggacttgacgaaaaggtgctgtttaacacaataacctataatgatgacgtaagtgttatcgagaaaaagacgaaattcaactttttgcaggcctaccaccagattaagaaagtgctcgctgaagatatgcagaagctgactaccgagcaattagacaatatcggccagatactgagcacatataagtctgataacaaaaggactgaggaactatccgcgctcggtctggagaagaaaattatcgacgcacttttggggatcaatggactgtcaaagttcgcccacctcagcctgaaagctctgcgtaagattaacccctaccttgaagagggcaagatctacaatgaagcctgcaccgcagccggctatgatttcaaagctcatgccaacacacagaagaccgagttgctccctgcatacaaagaggaaatggacgacattacgagtccagtcgcgcggcgagctatagcccaatctatcaaggtgattaatgcaatcatcagagagcagaaagggagccccctgtatattaacatagaattagccagggagatggctaagggatttgatgagcgcactcagatcgacaaggccaataaagaaaaccaggcaaagaatgagcggattatggaaagaatcaggacagagttccacaaagctaaccctaccggtatggatctgattaagctaaaactctgggaggaacaagacggccgctccccatactcgcagaaggccatctctataaaccgactgtttgagccggggtatgtggatatcgaccatattgtcccctactccatctcattcgatgacagttttaaaaataaggttcttgtgttcagcgatgaaaaccgggacaagggaaatcgtttgcctattgcgtatctgcagtccaaatttggcgccaaggctgcagagaacttcatgatctgggtacagtctaatataaaagattacaagaaaagacaaaagctcctgaagagggaaattactgaggaagacatcaacaaatttaaggagcgcaatttacaggatacaaaaaccattagccggttcctgtacaactatatcaatgactaccttttgtttgccccatcagacacgggtaagaaaaagagagtgaccgctgtcaacgggacaataactgcctatctcaggaagcgatggggcatcaataaaattcgcgcaaacggagataagcaccatgcggtggacgccgttgtgatcgcttgtaccacagataaaatgattaaggacctgagttccttcagccggtaccacgagctagaatatactcacaccgatacagagtcttttctggtcaattcactcaccggcgaaatcctgaaaagattcccctacccttgggaggacttcaggccagaacttatggcccgtttgagtgataaccccgcagacgctctgcgcaagttaaatctcatattttatcatgggattgatctgagcactatcaagccgatcttcgtgtcccggatgcctagacacaaagtaacgggagccgcacataaggccacaattaaatctgctaggtgccttgacaacggtatcgttatttgtaagacctcgctgcagaacttgaaactcgataaggagggcgagatagcgaattactacgcccccgaaagcgacactatcctgtataacgcactaaaagagcgactgcggtcctacgataataagccagctaaggcctttgccgaacctttctataaacccaaggctgacgggaccccaggacccctcgtgaaaaaggtcaaagtgtacgagaagtcaacactgaacgtcgcagtgcagcaaaataccgccgttgcggacaacgatagtatggtgcgcgtagacgtctttcacgtgaagggcaatggttattaccttgttcctatttatatcgctgatactttgaaaaaggagctgccaaacaaagccattgtggcatacaagccgtacgccgactggcccgtcatggatgactctaatttcatctttagcttatatcctaacgatctcataaaattcgaacacaaaaattccgtgaagtttgctaaggtaaacaaggagtcaacactgaatgacttctacagcacgaaatctgaaatcgtgtattttaaggggtgcaacattaataccggcgcaatcactattatcaaccatgagaacacatacgttgtctccagtcttggagtgaaaaccctgccaagcctagaaaagtatcaggccgatgtgctcggcaattacacaaaggtcaaaaaggaggttagaaaacccttcaggtga

SEQ ID NO: 2727 - RNA, 3264 nt, synthetic construct
  misc_feature 1..3264: note = Cas9 variant
  source 1..3264: mol_type = other RNA
atgagatacaagatcggcctggacattgggataaccagcgtgggatgggccgtcatcaacctcgatattcccaggatcgaggaccttggtgttcggattttcgatcgcgctgaaaatcctcagacaggcgagtccctggcattgccacgacgtttagccagatctgcgaggcggcgcctgagaaggcggaaacaccgcctagaacgaatcagaaggctcataatccgggaggggattctgactaaggaagaacttgacaaactgtttgaggaaaagcatgagatcgatgtgtggcaattgcgtgtagaagctctcgaccgcaaactgaacaatgatgagctggccagagtgctcttacacctggcaaagaggcggggattcaagtcaaaccgaaaaagtgagcgcagcaataaggaaaactccacgatgcttaaacatattgaggaaaatagagccatcttgtcttcgtataggaccgtcggcgagatgatagtgaaggacccgaaatttgctctgcacaagcggaacaagggtgaaaattacacaaacactattgcacgcgatgacctagagagagagatcaggctcattttctcaaaacagcgtgaatttgggaatatgagctgcaccgaggagttcgagaacgaatatatcgccatctgggctagtcagcggcccgttgcctccaaggatgacattgagaaaaaggtgggattttgtacattcgagcctaaagaaaagcgagcgccaaaagcaacctacacttttcagtctttcatagcctgggagcatatcaataagctgagacttattagcccctccggcacaaggggcctgaccgatgaagaacgccggttgctctatgaacaggcttttcaaaagaacaaaatcacgtaccacgacataagaactctgttacatctgcctgacgatacctatttcaaggggattgtctacgacaggggagagtcacgcaaacagaatgagaacatccgatttctcgaacttgatgcctaccaccagatccggaaggcagtggacaaagtatatggtaagggcaagagtagctctttcctgccaattgatttcgacacatttgggtacgctttgactctattcaaagatgacgccgatatccgttcctatctgagaaacgagtacgaacaaaatggaaagaggatgcccaacctcgcgaataaagtttatgacaacgagctgattgaggaacttctgaatttgtcatttaccaagttcggccacctcagcctgaaagccttacgcagtatactgccttacatggagcagggtgaagtgtattcttccgcatgcgagcgggctgggtacacatttaccggaccaaagaagaaacagaagacgatgctactcccgaacattccccctatcgccaatccagtcgtgatgagagctctgactcaggccaggaaagtggtcaacgcaatcatcaagaaatacggcagccccgtttcgattcatatagaacttgcccgagatttgtctcaaacattcgacgagcgccggaagaccaagaaagagcaggacgaaaatagaaagaaaaacgagactgctatcaggcagctgatggaatatggcctcacactgaatcctaccgggcacgatattgtgaagtttaaactttggtccgagcaaaacggacgttgtgcgtactcactgcagccaatcgaaattgagcgcttgctcgagcccggttatacggaagtagaccacgtgatcccgtacagtcggagcctggatgactcctataccaataaggtcttagtgctgacaaaagagaacagagaaaagggcaataggatacctgcagagtacctaggggttggaactgaacgatggcagcagttcgagacctttgtgctcacaaacaagcaattctctaaaaagaaacgggatcgcctgcttagattgcattatgacgagaacgaagagactgaatttaagaataggaacctgaatgatacccggtacatcagccgattctttgccaacttcattagagagcacctcaaattcgctgagtcagacgataagcagaaggtctacacagtgaatggccgcgtaaccgcccatctgaggagtcgttgggaatttaacaaaaatcgggaggaatccgacttacaccatgcagttgatgccgtgatcgtcgcttgcactacgcccagcgacattgccaaggtgacagcattctatcagagaagggagcagaacaaagaactggcgaagaaaaccgagccacactttcctcaaccctggccacacttcgctgatgagcttcgcgcccgattgtctaagcatcccaaggaatcaatcaaagcactcaatctgggtaactacgacgaccagaagctagagagtctgcagcctgtctttgtgagcagaatgccaaaacggtccgttactggggccgctcaccaggaaaccctcaggcgctatgtgggcatagatgagcgttctggaaagattcaaacagtagtcaaaaccaagctgtcggaaatcaaacttgacgccagcggccatttcccgatgtacgggaaagagtccgatcccagaacttatgaggcaattcggcagaggttgctggaacacaataacgaccctaagaaggcttttcaggagccattatacaagcccaaaaagaatggagaacctggtccagtgatccgcacagttaaaataatcgatacgaagaaccaggtgattcccctcaatgacggcaagaccgtcgcctataactcaaacatcgtgcgagtagatgtgttcgagaaagacgggaagtactactgtgttccggtctatactatggatattatgaaaggaatcctgcctaataaggcgatagaaccaaacaaaccctacagtgagtggaaggagatgacagaagactatacctttagattctctctttaccctaatgatctgattcggatcgagttgcccagggaaaagatcattaaaacagccggcggtgaggagatcaagattaaagacctctttgcttattacaagactatacacagcgggaccgcaggcctggagctagtgtcccatgattgctcattcagcctgtctggagtgggctcccgcacgctcaaaagatttgagaagtatcaagtcgacgttctggggaacatctacaaggtgaggggagaaaaacgggtgggtcttgccagtagcgctcactctaagaccggcgagacaattcgtccattgcagtccactcgcgactga

SEQ ID NO: 2728 - RNA, 3264 nt, synthetic construct
  misc_feature 1..3264: note = Cas9 variant
  source 1..3264: mol_type = other RNA
atgagatacaagatcggcctggacattgggataaccagcgtgggatgggccgtcatcaacctcgatcttcccaggattgaggacctgggtgttcggatcttcgatcgcgctgaaaatcctcagacaggcgagtccttggcattaccacgacgtctggccagatctgcgaggcggcgcctaagaaggcggcgccaccgactcgaaagaattaggcggctgcttactcgtgagaacgtgctgacgcaagaagagttggacaaactctttgagaagaaacatgaaatcgatgtatggcagctgcgcgtggaggctctggacagaaagctcaataacgatgaattagccagggtcctgcttcacttggcaaaacggcgagggttcaagtcaaatcgcaagagtgagagaagcaacaaagaaaattccaccatgctgaagcatatagaggagaacaggtctatcctaacaggatatcggactgtgggcgaaatgattgttcgcgacccgaaatttgtgctccacaagagaaataaaggtgagaactacaccaatacaatcgccagggatgacctggaacgtgagattcagcttatcttcgctcggcagcgagagtttgggaacatgatatgcaccgaagcattcgagaatgaatatattgccatctggtcgtcacaaagacccgtcgctagcaaggatgacattgagaagaaagtgggattttgtactttcgaacctaaggagaaaagggccccaaaggcgacatacacctttcagagtttcatcgcatgggagcatatcaacaaactgcgcttggtatccccctctggcacgcgggaactcactgatgaggaaagaaggctgttatatgagcaggcctttcagaagaataaactgacctaccacgacattcgcacactccttcaccttcctgacgatacttatttcaagggcatagtttacgactggggagaaccattgaagcaaaacgagaacatccgatttctagagctggatgcttaccatcagattcggaaaaccgtggacaaggtctatgggcgtggtaaaagctcctcattcctccccatcgatttcgacacatttggctacgccctgacccttttcaaggatgacgcacacataagaagttatctgaggaatgaatacgagcagaacgggaaacgcattgctaatttggccaacaaggtgtatgataatgaactcatcgaggagctgttaaacctgagctttacgaagttcggacatctatctctcaaagcgctgcggaatatccttccttacatggaacagggcgaggtgtattcctcagcctgcgaaagagcaggttacacttttacagggccaaccaagaaacaaaagactgtcttgctgccgacaattccccctatcgctaacccagttgtgatgagggccctcacccaggctcgaaaagtagtgaatgccattataaagaagtacggaagccccgtcagtatccacattgagctggcacgcgacctttctcagacgttcgatgaacggaaaaagaccaaaaaggagcaagacgagaacagaaaaaggaatgaaacagccatccgtcagctgatcgagtatggcttgactcgcaaccctaccggccacgacattgtgaagtttaagctctggtccgaacagaatgggcggtgtgcttacagcctgcagccaatagagatcaaaagattactggaacccggatatgttgaggtggatcatgtcattccgtactcgaggtctctagacgattcctatacaaacaaggtgctcgtactgactaaagagaatcgagaaaagggtaaccggatccctgcggagtaccttggcgttgggaccgaacgctggcaacagttcgagacatttgtgttgaccaacaaacagttctcaaagaaaaagagagacaggctgctccggctgcactatgatgaaaatgaggaggcagaatggaagaaccgaagtttaaatgacactagatacattagccgctttttcgccaactttatcagggagcatctgaaattcgctgattccgacgataagcagaaagtctacacggtgaatggaggcgtcacagcccaccttcgttctcggtgggacttcaacaagaatagagaagagagcgatttgcatcacgcagtggacgccgctatagttgcctgcaccactctctcagatatcgcaagggtgaccgcgttttatcaacgccgagagcaggctaaagaactggccaagaagacagagccccacttcccacagccttggccccattttgcagacgaactaagagcccggctgagtaaaaacccaaaggagtccattaaagctctcaatctgggtaactacgacaatgaaaagctggagagcttgcagcccgtattcgtctctaggatgcctaaacgctcagtgaccggggccgcacaccaagagactctgcgtagatatatcggcattgatgaacggagtggaaagatccagacagttgtgaagacgaaattaagcgagataaagctcgacgcttccggccattttccaatgtacgggaaagaatctgatccgaggacctatgaggccattcgcctgcgacttctggaacacaacaatgaccccagaaaggcgttccaggagcctttgtacaaaccaaagaagaacggagagctcggtcccatcattcggactgtcaaaatcatagatacaaagaatcaggtgatccctctgaacgacggcaaaaccgtagcctataactcgaatattgtgagggttgatgtctttgaaaaggacgggaaatactactgtgtgccagtgtatacaatggatatcatgaagaaagtcctacccaacaaggctattgagccgaataagccttacagcgaatggaaagagatgactgaagactataccttccgcttttccctgtacccaaacgatctcatcagaatagagctgcccagggagaagacggttaaaaccacagcaggacacgaaattaatatcaaggacgtgttcgtgtattacaaaactatcgattcagccaccggcggtcttgagttgattagtcatgacaactcttttagcctgcgggggatcggctcccgtacattaaagcgcttcgaaaagtatcaagtagacgtcctcggaaatatttacaaagtgcgaggcgagaagagagttgggctggcttcaagcgcccaccctgagactagggaaaccatacggccccttcagtctacgcgcgattga

SEQ ID NO: 2729 - RNA, 3264 nt, synthetic construct
  misc_feature 1..3264: note = Cas9 variant
  source 1..3264: mol_type = other RNA
atgaagaaactggtgctcggccttgacatcggggtcgccagcgttggatggggtattatagatgctgagaacggcgacgtggtagataccggggtgagactgttctcctctagggacgcatcagaaaatgagagtcggcgcacaagccgacagtcccgtagattgtctaggcggaagaaacaccgcagagaaaggatcaagcaattactgctagcccatgatatggacatttgcgatatcgtcaacgagaatccctacgaactccgggtgaaaggactgaacgagaaacttgaggtttcggaaatttatgtggcgctgactcacttggctaagcgccgaggcgtctcatacctcgacgatgtggtagaggaaggtgggacgatcaaaagcgagcatctgaataagaacatggaggaaataaaaagtggaaagatgccttgtgagatccagctggaaagatttgagaaatatggccaggttaggggcatgattgaaatcaatcaggacaccgaggagtcctctttcctcgtgaacatttttcggacaagcgattacatcaaggaagccaagactatattagcaacccaacagaaattccacaagcagattacaaatgagtttatcgacgaatatattcatatcatggcctccaaacgtgattacttcatcgggccaggaaacgagaagtcacgcaccgactatggtgtctacagaactaatggcgacacatgggataacctgtttgaaattcttatagggaaatgcagtgtgttcccggaggagaccagggctgcacggagctcttacgtggcccaggaatttaatttgctgaacgacctaaataacctcaagatctccaacctggagtcaggaaaacttagcgctagtcaaaagcacgatattgtcgaaaaggttaaaaattctaagaaattcggcacgaaggacctgttgaaatatatcgcctccgtgtgtgagtgcaagatagaagatattggtgggtgtcgagtagacaagaaccgcaaacccatcatgcacacttttgagaattacagaaaggtgcataacgcgctcaatgaggcaggagtcgatctgaggttaagcgaaaccgactatgatgagctgatgaaaatcatgacactcaactcggaaactcttgagattaagaaacagtgcaaggagaagctgcctcagttgaccgaagactacctaaatgtgtgtctggttctcaacaaaaagggcgccttctctggctggcacgctctgtcccttaaagccatgaagctgatgatgccagagttgtatgggacatcaaagaatcagatgcaaatcattcataccatgcagctcggaaaggcatacctgaagcccttaaaccagcaaaaatatctgaatagtgaagctatactagaggaaatctacaaccctattgccgcgcggagcatccgccagacgatcaaggtgactaatgccattctcaaaaagtacggtcacctggattccgtcataatcgagatgccaagagactatcagacatctgaggacgaaaggaaaatgattgagaagatgcagaaagaaaacgagaaggaaaagaaagcagctcttaagcgtgcccgggaggagtacccctttcctgatgaagcattccgaaatcacaaagagttggccaccaagctgagactctggtatcaacaggaccagttctgcgtgtacagcggcaggaaaatctcagtagttgatctggtgcgcaacccaaaccagtttgaaattgaccatatcataccgcaaagtgtctcccttgatgacagcctgaataacaaggtgttgtgtttctctgaggaaaatcagaagaaagggcagcagactcccttttattaccacaagggaaaatcaggcaactggacatatgagcaatacaaactcttcgtcgagaaactgtttgataagaagaaaatcagtaataagaaacgggaattactgctattcgaggaagacattaacaagtgggatgtgagaaggggttttatcgcacgcaatctcgttgacacccgatacgccagccgggtgattctgaactcctatcagcagtacttcgggaatcatgagatgggcacgaaagtaaaggtcgtgcgtggaaagtttacctctcagcttagaaagaagtggaggatcttcaaagatcgcaacgagtcgcacagccatcacgctatagacgcgttgattgttgcagccacagctaatctgcggctctggaagaaaaacactctgggcgtgtccgatgaagggaaggtctatgacaaagagaccggagaaatcttaccttttgagaagctgacagaatcagagtacaatgagatgatgaacaaggaaccatatcttaatttcaaaactaagttgcaaaacattgagaccaaagtgaagtacagttatagagtatctaaaaaggtgaacaggaagatcagcgacgccacaatatactccacccgagaacgcgatggtatcgactacattgttggcaaaatcaagaatatttatgatgtcaaaacttacaaggaccagtttctcaaacggtataagaagaacaaagagcagttcctgatgtaccaacacgatccccagacgttcgcaatcctagaaaatataatggccacatatcaggacgctgagaacccttttctggcctacaagaaagagtatggggtgattagaaagtacagcaaaaagggaggcggttcaccagtgacctctctcaagttcatcgataaagtcctggggcagaagatcgaccttactgctaaaaatcaagcggctttgcccaagaacaaaaaggttgtgctgcagtccattaccccgtacagggccgatgtgtattacgacgaaatcgataagcgttatcatttaattggcgtaaaatacagtctctttagcttctctaagcagggatatgtcataaatcctatcgcataccagaaactgcttgagaaggaacaaattcactccgagatgaaattttgcttctcactgtatcgcgaagacatcattgagtttggcgaggatcccgacagtttgacacggtacagattctggagcaagaacgaatcggggaaaaataagatcgaggtgaagccaatagaaaaacctaactttgagaagcagaccgttctcactatcacgaaaaagattaaaatcctgaataagtaccagacagacgtgctaggaaactccttcaaggcccaggaggaaaaagatcccaggaatattgagtga

SEQ ID NO: 2730 - RNA, 3264 nt, synthetic construct
  misc_feature 1..3264: note = Cas9 variant
  source 1..3264: mol_type = other RNA
atgagatacaagatcggcctggacattgggataaccagcgtgggatgggccgtcatgaacctcgatatccccaggattgaggaccttggtgttcggatcttcgatcgcgctgaaaatcctcagacaggcgagtccctggcattgccacgacgtttagccagatctgcgaggcggcgcctgagaaggcggaaacaccgcctagaacgaattagaaggctcgtgatccgggaggggatactgactaaggaagaacttgacaaactgtttgaggaaaagcatgagatcgatgtatggcaattgcgtgtggaagctctcgaccgcaaactgaacaatgatgagctggccagagtcctcttacacctggcaaagaggcggggattcaagtcaaaccgaaaaagtgagcgcagcaataaggaaaactccacgatgcttaaacatattgaggaaaatagagccatcttgtcttcgtataggaccgtgggcgagatgattgttaaggacccgaaatttgctctgcacaagcggaacaagggtgaaaattacacaaacactatcgcacgcgatgacctagagagagagataaggctcattttctcaaaacagcgtgaatttgggaatatgagctgcaccgaggagttcgagaacgaatatatcacaatttgggccagtcagcggcccgtggcttccaaggatgacatcgagaaaaaggtcggattttgtaccttcgagcctaaagaaaagcgagccccaaaagcgacttacacatttcagtctttcatcgcatgggagcatattaataagctgagacttataagcccctccggcgccaggggcctgaccgatgaggaacgccggttgctctatgaacaggcttttcaaaagaacaaaatcacgtaccacgacattagaactctgttacatctgcctgacgatacctatttcaaggggatcgtgtacgacaggggagagtcacgcaaacagaatgagaacatacgatttctcgaacttgatgcctaccaccagattcggaaggcagtagacaaagtttatggtaagggcaagagtagctctttcctgccaatcgatttcgacacatttgggtacgctttgactctattcaaagatgacgccgatatccactcctatctgcgtaacgagtacgaacaaaatggaaagagaatgcccaacctcgcgaataaagtgtatgacaacgagctgattgaggaacttctgaatttgtcatttaccaagttcggccatctcagcctgaaagccttaaggagtatcctgccttacatggagcagggtgaagtctattcttccgcatgcgagcgcgctgggtacacatttaccggaccaaagaagaaacagaagacgatgctactcccgaacattccccctatagccaatccagtggtgatgcgggctctgactcaggccagaaaagtcgttaacgcaatcattaagaaatacggcagccccgtgtcgatccacatcgaacttgccagggatttgtctcaaacattcgacgagcgacgcaagaccaagaaagagcaggacgaaaatcggaagaaaaacgagactgctattagacagctgatggaatatggcctcacactgaatcctaccgggcacgatatagtaaagtttaaactttggtccgagcaaaacggaaggtgtgcgtactcactgcagccaatcgaaattgagcgtttgctcgagcccggttatgtggaagtcgaccatgtgatcccgtacagtcgcagcctggatgactcctatacgaataaggttttagtgctgacccgggagaacagagaaaaaggcaataggattcctgcagagtacctaggggtcggaacagaacgatggcagcagttcgagacttttgtgctcaccaacaagcaattctctaagaaaaagcgggatcgcctgcttagattgcactatgacgagaacgaagagacagaatttaaaaataggaacctgaatgatactcggtacatcagccgattctttgccaacttcataagagagcatctcaagttcgctgagtcagacgataaacagaaggtatacaccgttaatggccgcgtgacagcccacctgaggagtcgttgggaatttaacaagaatcgggaggaatccgacttacatcacgcagtcgatgccgctatcgtggcctgcaccactcccagcgacattgcaaaagtcacggcgttctatcagagaagggagcagaacaaggaactggctaaaaagacagagccacactttcctcaaccctggccacatttcgccgatgagcttcgcgcacgattgtctaaacaccccaaggaatcaatcaaggccctcaatctgggtaactacgacgaccagaaactagagagtctgcagcctgtgtttgttagcagaatgccaaagcggtccgtgaccggggctgcccatcaggaaactctcaggcgctatgtaggcattgatgagcgttctggaaaaatccaaaccgtcgtgaagacaaaactgtcggaaataaaacttgacgcaagcggccacttcccgatgtacgggaaggagtccgatcccagaacctatgaggctattcggcagaggttgctggaacacaataacgaccctaaaaaggcctttcaggagccattatacaaacccaagaaaaatggagaacctggtccagttatccgcactgtgaagattatcgatacaaagaaccaggtcatacccctcaatgacggcaagacggtggcgtataactcaaacatcgtacgagtggatgttttcgagaaggacgggaaatactactgtgtcccggtgtataccatggatattatgaagggaatcctgcctaataaagccattgaaccaaacaagccctacagtgagtggaaagagatgactgaagactatacatttagattctctctttaccctaatgatctgatccggatagagttgcccagggaaaagaccgtgaagacagctgcaggcgaggagattaacgtcaaagacgtttttgtgtattacaagactatcgatagcgccaatggtgggctcgaactgatctcccatgaccaccgcttctcactaagaggcgtgggaagcaggaccctgaaacggtttgagaagtatcaagtagacgtcctcggcaacatttacaaagtgcgtggggaaaagcgcgttggactggcttcttccgcccatagtaagacgggtgagaccgtgcgaccacttcagagcacaagagattga

SEQ ID NO: 2731 - RNA, 3264 nt, synthetic construct
  misc_feature 1..3264: note = Cas9 variant
  source 1..3264: mol_type = other RNA
atgagatacaagatcggcctggacattgggataaccagcgtgggatgggccgtcatgaacctcgatatccccaggattgaggaccttggtgttcggatcttcgatcgcgctgaaaatcctcagacaggcgagtccctggcattgccacgacgtttagccagatctgcgaggcggcgcctgagaaggcggaaacaccgcctagaacgaattagaaggctcgtgatccgggaggggatactgactaaggaagaacttgacaaactgtttgaggaaaagcatgagatcgatgtatggcaattgcgtgtggaagctctcgaccgcaaactgaacaatgatgagctggccagagtcctcttacacctggcaaagaggcggggattcaagtcaaaccgaaaaagtgagcgcagcaataaggaaaactccacgatgcttaaacatattgaggaaaatagagccatcttgtcttcgtataggaccgtgggcgagatgattgttaaggacccgaaatttgctctgcacaagcggaacaagggtgaaaattacacaaacactatcgcacgcgatgacctagagagagagataaggctcattttctcaaaacagcgtgaatttgggaatatgagctgcaccgaggagttcgagaacgaatatatcacaatttgggccagtcagcggcccgtggcttccaaggatgacatcgagaaaaaggtcggattttgtaccttcgagcctaaagaaaagcgagccccaaaagcgacttacacatttcagtctttcatcgcatgggagcatattaataagctgagacttataagcccctccggcgccaggggcctgaccgatgaggaacgccggttgctctatgaacaggcttttcaaaagaacaaaatcacgtaccacgacattagaactctgttacatctgcctgacgatacctatttcaaggggatcgtgtacgacaggggagagtcacgcaaacagaatgagaacatacgatttctcgaacttgatgcctaccaccagattcggaaggcagtagacaaagtttatggtaagggcaagagtagctctttcctgccaatcgatttcgacacatttgggtacgctttgactctattcaaagatgacgccgatatccactcctatctgcgtaacgagtacgaacaaaatggaaagagaatgcccaacctcgcgaataaagtgtatgacaacgagctgattgaggaacttctgaatttgtcatttaccaagttcggccatctcagcctgaaagccttaaggagtatcctgccttacatggagcagggtgaagtctattcttccgcatgcgagcgcgctgggtacacatttaccggaccaaagaagaaacagaagacgatgctactcccgaacattccccctatagccaatccagtggtgatgcgggctctgactcaggccagaaaagtcgttaacgcaatcattaagaaatacggcagccccgtgtcgatccacatcgaacttgccagggatttgtctcaaacattcgacgagcgacgcaagaccaagaaagagcaggacgaaaatcggaagaaaaacgagactgctattagacagctgatggaatatggcctcacactgaatcctaccgggcacgatatagtaaagtttaaactttggtccgagcaaaacggaaggtgtgcgtactcactgcagccaatcgaaattgagcgtttgctcgagcccggttatgtggaagtcgaccatgtgatcccgtacagtcgcagcctggatgactcctatacgaataaggttttagtgctgacccgggagaacagagaaaaaggcaataggattcctgcagagtacctaggggtcggaacagaacgatggcagcagttcgagacttttgtgctcaccaacaagcaattctctaagaaaaagcgggatcgcctgcttagattgcactatgacgagaacgaagagacagaatttaaaaataggaacctgaatgatactcggtacatcagccgattctttgccaacttcataagagagcatctcaagttcgctgagtcagacgataaacagaaggtatacaccgttaatggccgcgtgacagcccacctgaggagtcgttgggaatttaacaagaatcgggaggaatccgacttacatcacgcagtcgatgccgtgatcgtcgcttgcaccactcccagcgacattgccaaagtgacggcattctatcagagaagggagcagaacaaggaactggcgaaaaagacagagccacactttcctcaaccctggccacatttcgctgatgagcttcgcgcccgattgtctaaacaccccaaggaatcaatcaaggcactcaatctgggtaactacgacgaccagaaactagagagtctgcagcctgtttttgtgagcagaatgccaaagcggtccgtaaccggggccgctcatcaggaaactctcaggcgctatgtcggcattgatgagcgttctggaaaaatccaaaccgtggttaagacaaaactgtcggaaataaaacttgacgccagcggccacttcccgatgtacgggaaggagtccgatcccagaacctatgaggcaattcggcagaggttgctggaacacaataacgaccctaaaaaggcttttcaggagccattatacaaacccaagaaaaatggagaacctggtccagtgatccgcactgtcaagattatcgatacaaagaaccaggtgatacccctcaatgacggcaagacggtagcctataactcaaacatcgtgcgagttgatgtcttcgagaaggacgggaaatactactgtgtgccggtgtataccatggatattatgaagggaatcctgcctaataaagcgattgaaccaaacaagccctacagtgagtggaaagagatgactgaagactatacatttagattctctctttaccctaatgatctgatccggatagagttgcccagggaaaagaccgtcaagacagccgctggcgaggagattaacgttaaagacgtgtttgtgtattacaagactatcgatagcgcaaatggtgggctcgaactgatctcccatgaccaccgcttctcactaagaggcgtaggaagcaggaccctgaaacggtttgagaagtatcaagtcgacgtgctcggcaacatttacaaagttcgtggggaaaagcgcgtgggactggcctcttccgctcatagtaagccaggtaaaacgatccgacctcttcagagcaccagagattga

SEQ ID NO: 2732 - RNA, 3264 nt, synthetic construct
  misc_feature 1..3264: note = Cas9 variant
  source 1..3264: mol_type = other RNA
atgagatacaagatcggcctggacattgggataaccagcgtgggatgggccgtcatcaacctcgatattcccaggatcgaggaccttggtgttcggattttcgatcgcgctgaaaatcctcagacaggcgagtccctggcattgccacgacgtttagccagatctgcgaggcggcgcctgagaaggcggaaacaccgcctagaacgaatcagaaggctcataatccgggaggggattctgactaaggaggaacttgacaaactgtttgaggaaaagcatgagatcgatgtgtggcaattgcgtgtagaagctctcgaccgcaaactgaacaatgatgagctggccagagtgctcttacacctggcaaagaggcggggattcaagtcaaaccgaaaaagtgagcgcagcaataaggaaaactccacgatgcttaaacatattgaggaaaatagagccatcttgtctggctataggaccgtcggtgagatgatagtgaaggacccgaaatttgctctgcacaagcggaacaagggggaaaattacacaaacactattgcacgcgatgacctagagcatgagatcagactcattttctcgaaacagagggaatttggaaatatgtcatgcaccgagaagttcgaaaacgagtatatcacaatctgggccagccagcgtcccgttgctagtaaagatgacattgaaaagaaagtgggcttttgtaccttcgagcctaaggagaaacgggccccaaaggcgacttacacatttcagtccttcatagcatgggaacacatcaataagctgcgacttatttttccctctggcgccagagggctgaccgatgaggaaaggcgcttgctctatgagcaagccttccagaaaaacaagatcacgtaccacgacatacggactctgttacatctgcctgacgatacctattttaaaggaattgtctacgacagaggtgaaagcaggaagcagaatgagaacatccgcttcctcgagcttgatgcttaccaccagatccgaaaagcagtggacaaggtatatggcaaggggaaatcctcaagtttcctgccaattgattttgacacattcggatacgctttgactctatttaaggatgacgccgatatccatagctatctgcggaacgaatacgagcaaaatggcaaacgtatgcccaacctcgcgaataaggtttatgacaacgaactgattgaggagcttctgaatttgtctttcaccaaatttggtcacctctccctgaaggccttaagatcaatactgccttacatggaacagggggaggtgtatagcagtgcatgcgaaagggctggatacacattcaccggcccaaagaaaaagcagaaaacgatgctactcccgaacattccccctatcgccaatccagtcgtgatgcgcgctctgactcaggcccggaaggtggtcaacgcaatcatcaaaaagtacggctctcccgtttccattcacatagagcttgccagagatttgagccaaacatttgacgaaaggcgaaagaccaaaaaggagcaggacgagaatcgcaaaaagaacgaaactgctatccggcagctgatggagtatgggctcacactgaatcctaccggacatgatattgtgaaattcaaactttggtcggaacaaaacggtagatgtgcgtactctctgcagccaatcgagattgaaaggttgctcgagcccggctatgtagaggtggaccacgtcatcccgtactcccgttcactggatgacagttatacgaataaagtgttagttctgacccgcgaaaaccgggagaaggggaatagaatacctgcagaatacctaggagtgggcacagagaggtggcagcagtttgaaactttcgtcctcaccaacaagcaatttagcaaaaagaaacgagatcggctgcttcgcttgcattatgacgagaacgaggaaacagagttcaagaatagaaacctgaatgatactaggtacatctcccggtttttcgccaacttcattcgagaacacctcaaatttgctgagtctgacgataagcagaaggtgtacaccgtaaatggtagagttacaagccatctgcgctcaaggtgggacttcaacaaaaatcgtgaggaaagtgatttacaccacgccgtggacgcagccatcgtcgcttgcaccactccctccgatattgccaaggtgacggcattttatcagcggagagagcagaacaaagaactggcgaagaaaacagagccacatttccctcaaccctggccacactttgctgacgaacttagggcccgcttgagcaagcatcccaaggagtctatcaaagcactcaatctggggaactacgacgatcagaagctagagtcactgcagcctgtcttcgtgagtcgaatgccaaaaagaagcgttaccggcgccgctcaccaggaaactctccggaggtatataggaattgacgagcgctccggcaagatccaaaccgtggtaaaaacaaagctgtctgaaattaaacttgatgcctcggggcactttccgatgtacggaaaggagagcgacccccgtacctatgaagcaatcagacagcggttgctggagcataataacgatcctaagaaggctttccaggagccattatacaagcccaaaaagaatggtgaacctggcccaataatcaggactgtcaaaattatcgacacaaagaaccaggtgattcccctcaatgatgggaagacggttgcctataactccaacatcgtgcgcgtcgacgtgtttgagaaagatggaaagtactactgtgtaccggtgtataccatggacataatgaaaggcattctgcctaataaggcgatcgaaccaaacaaaccctactcagagtggaaggaaatgactgaggattatacattccgatttagtctttaccctaatgacctgatcagaattgagttgccccgggaaaagaccgttaaaacaactaccggtgaggaaatcaacgtcaaggatgtgttcgtgtattacaaaacgattgactctgccaccgggggcctcgagctgataagccacgacaataggttttccctacgcggagtcggctcaagaacactgaagaggttcgagaaatatcaagttgatgtgctcgggaacatctacaaggtgcggggagaaaagcgtgtaggtctggctagctctgcacattccaaaactggcgagaccattcgcccacttcagagtacacgagactga

SEQ ID NO: 2733 - RNA, 3264 nt, synthetic construct
  misc_feature 1..3264: note = Cas9 variant
  source 1..3264: mol_type = other RNA
atgagatacaagatcggcctggacattgggataaccagcgtgggatgggccgtcatcaacctcgatattcccaggatcgaggaccttggtgttcggattttcgatcgcgctgaaaatcctcagacaggcgagtccctggcattgccacgacgtttagccagatctgcgaggcggcgcctgagaaggcggaaacaccgcctagaacgaatcagaaggctcctgatacgggagggggtgcttactaaggaagaactggacaaattgtttgaggaaaagcatgagatcgatgtatggcaactccgtgtggaagctctggaccgcaaactgaacaatgatgagctcgtcagagtgttactgcaccttgccaagaggcggggattcaagtcaaaccgacagagtgagcgcagcaataaagaaaactccacgatgttgaagcatattgaggaaaatagagcaatcctgtctggctataggaccgttggtgagatgattgtgaaagacccgaagtttgccctacacaaacggaacaagggggaaaattacacaaacactatcgctcgcgatgacctcgagagagagataaggctgattttctcgaagcagcgtgaatttggaaatatgtcatgcaccgaggagttcgagaacgaatatatcgcaatttgggccagccagcggcccgtcgctagtaaagatgacatcgagaagaaagtgggcttttgtacattcgagcctaaggaaaaacgagccccaaaggcgacctacacttttcaatccttcatcgcatgggagcatattaataaacttagactgatatctcccagcggcacaagggggttgaccgatgaggaacgccggctcctgtatgaacaggcctttcagaagaacaagatcacgtaccacgacattagaactttactgcacctccctgacgatacctatttcaaaggaatcgtatacgactggggtgagtcccttaagcagaatgagaacataaggtttctggaattggatgcttaccatcaaattcgcaaagccatcgacaaggtttatggcaaagggaagtcaagtagcttcctaccaatcgatttcgacacatttggatacgcactgactctcttcaaggatgacgctgatattcgatcttatctgcggaacgagtacgaacagaatggcaaacgtatcgccaaccttgcgaataaggtgtatgacaacgagctgattgaggaattgctcaatctgtcctttaccaaattcggtcacttatcactgaaggccctaagaaacatactcccctacatggagcagggggaagtctatagcagtgcatgcgagaaagctggatacacatttaccggccctaagaagaaacagaagacggtgctgcttccaactatcccgcccattgtgaatcctgtcgttatgagggccttgacacaagctcgcaaagtggtaaacgccatcatcaagaaatacggctctccagtgtccattcatatagaactggcacgggatctcagccagaccttcgacgagagaaggaagactaagcgagagcaggacgaaaatcgcaaacggaacgagacagccatcagacaactgatggaatatgggcttaccctgaatcccacgggattggatattgtcaagtttaaactctggtcggagcagaacggtaggtgtgcttactctctgcagcctatcgaaattgagcgtttactggagccaggctatgtggaagttgaccacgtgatcccctactcccgctcactagatgacagttataccaataaggtcctcgtgctgacaaaagagaaccgggaaaaggggaatagaataccggcggagtaccttggagtaggcactgaaaggtggcagcaattcgagacctttgttttgacaaacaaacagttcagcaagaagaaacgagatcggctgctccgcctgcactatgacgagaacgaagagatggaatttaagtccagaaatttaaacgatactaggtacatctctcggttctttgcaaatttcattcgagagcatctgaaattcgccgagagcgacgataagcagaaagtgtacaccgtcaacggtagagtgacatcacaccttcgcagtaggtgggactttaataagaaccgtgaagagtccgatttgcatcacgctgtcgacgccgcaatcgtggcctgcaccactcctagcgatattgctaaggttacggccttctatcagcggagagaacaaaataaagagctcgcaaagaaaacagaaccccagtttccacagccttggccccatttcgcggacgagctgagggctcgcctatctaagcacccaaaagagtcaatcaaggccctgaacctcgggaattacgacgatcagaagctggaaagtcttcaacccgtgtttgtaagccgaatgcctaaaagatccgtcaccggcgcagcccaccaggagactttgcggaggtatataggaattgacgaacgctctggcaagatccagaccgtggttaaaacaaagctgtcggagattaaattagatgctagcgggcatttcccaatgtacggaaaggaatccgacccgcgtacctatgaggccatcagacagcggctcctggagcacaacaatgatcccaagaaagcatttcaagaacctctttacaagcccaaaaagaacggtgagccaggccctataatcaggactgtgaaaattatcgacacaaagaatcaggtcattccactgaacgatgggaaaacggtggcttataattcaaacatcgtacgcatagacgtgttcgaaaaggatggaaagtactactgtgttcccgtctataccatggacattatgaaaggcgtgttgccgaacaaggccatcgagcctaataaaccatacagtgaatggaaggagatgactgaggattatacatttcgattctctctctaccccaacgacctgatcagaattgaactacctcgggagaaaaccgtgaagacagcggccggtgaagagatcaatattaaggatatgtttgtctattacaaaactatagacagcgctaacgggggcctggagctcatctcccatgacaattcattcagcctgaggggagttggctctcgcacccttaagagatttgaaaaatatcaggtggatgtgttggggaacatttacaaggtaaggggagagaaacgggtcggtctggcatccagtgcccacagcaagacgggcgaaaccatccgtcccttacaatctacacgcgactga

SEQ ID NO: 2734 - RNA, 3267 nt, synthetic construct
  misc_feature 1..3267: note = Cas9 variant
  source 1..3267: mol_type = other RNA
atgcccaaggagttcgaccctctgaaaccagccaagtacagactcgctcttgatatcggcagcaaatccattgggtttgcaataatcttcctgaaggaagacgtgaacaaattgttaaagccgtatgccattgtcaggtctggagttcggatctttggtgatggccgcacccccgcggctcctgggcagctgggatcaagtctagccgcagagcgacgtgtgaagagaagcattaggcggcaatacgcccgcaaaagaaagaggctccagcggctgcttcgcaatctgaaagaattgggcttctttccagacgattccaagctctgcaaatctttcgaggacctgaacccctatgaactgcgacacaagggtctcacaaaggagttaaaacctcatgagtttgggagactgcttatgcacatggctaagaataggggattccagtcgaaccggaaagtagatttgctggcagacaatatcgattcacaggccaaggctgaaactagcgccatgaaaagtgcgatagcaacgctacaatcccgtctcaacggcgagtttgaaaccctgggcgcctacctttatgagcgcttcaagaaaggggagacaatcaagtctagcaagactcagaaaggacagaaggctgaatacgagttttccatttcaagaaggatggtgaaacaggagttcgaccggctgtgggccgcacaagagcagtttaatccagaattgttcaacgagcaggctaagaataccctcaaagatacaatcttctttcagcgaaacctgttaccccaaaaggtcggtaagtgtaccttcctgcctgagcatgaacgcgccagtaaagcgctcccaagctctcagtattttagaattatctccgagcttaataagatatcattcactgacgccgaaggcctgattttgccgatcagcctagagcagaggaacaaactgctcaagagtctgcggattaaacaaaaactttcttttgatcgcatcagaacagaactgaatttggactccaccgtgctcatcaacctggagcacgcaagcaaggactcgattgagggggataagacgggatacttactgtctaagaaagaatacttcggccccgcttggagggacctatccctcgagactcaggatgccatagttaccgctctgcttacacatgaaaatgaggccgaattggtgcagaagctggtcgacgattttaacatcgcacacgacgtggccaaagctctcgcgaacgcacgtctggagtcacagtatatgcggcttagtaaggaggccattgaacgactgatccctgagttggaaaagggtgtagatagccaagacgggtacaaagttccagtgaagtatcacgaggctactgaggccgcaggattcggccatcactccgccctccaggaaaattgggctgattttcccaccctggacttaaaacagctgcattctgatgacaacgacaagtacacagtcgccgagctacctctcccatattacggcaaagtgataaccagacaggtggcattcgggacgggagatgtcaatgaccccgttgaaaagaggtttggtaaaattgcgaacccgactgtgcacatctgcctgaatcaagtacgcgtgcttttggatgagatcattgctaagtatggctacccttacgaagtcaacatcgagctggcccgggagctcaagcagaatcacgaacagagacagaggagcattaaacaacaggcagccaacaagaaagagaatgaagagatacgccgagaaatcaagcaggcttataaagtggagaaggcccggattatcacagactcagagatcagtcgtgcagatattgaaaagtggagactgtggaggcgctccaaaagcaagttatgtgtttactctgggaaaaagatatgcgagaccatgatcctgaacaatgaagtggaggtcgaccatattcttccccggtcaagaactggagataacagttatcagaataaagtgttggtactcaacaaggctaataggatcaagagcaaccgaacaccatgggaagccaaagagctgttcgaggcgcaaggctggtcctacgaagacattctaaaccgcatgcgggccctggataagcaccagctctttagattcgctgaaaattctatggacatctgggataaaaactataggtcgttcgaagcacgtgccctgaatgacacccgctacataagccgggttgtgaaggattatcttaaagtcgtgtgtcataaggacagaatcgtcgtgtccaacggtgctcacacggccttgattaggcgagagtttgggctgaatgacttactcggcaagaaaggagagaagaaccgggatgaccatcgccaccacgcaatcgatgcgtgcgttattggcgccctggacagatcaatgcttaggaaactgcagatcgctatggaagtggccgagaagcaaaatagtgcacggaacttcgtagggttgcaggaaccttggtttaatttctctacccaggtccgaagaagcataggacagatttacgtgtcccataaacccaaccacaattacgagggtgaaatctttgaggcttcaatttatggcctccgcctgatcagcgataagaggacagagaaatacgttgggataaagcgtaacccagaaactggaaagaccgacaaacccaagaaatctgtggtcgtgatctccgatcctaagacacaaaatcggtatggcctaagacataaattccacagtgagggtctgccaaagaagtactatgggctctctagctcctcagtattttgtctggaaatttacagggacgagaaaggcaactggcaggcctatactatcccgcgctacgaagcataccgaattgtgaagagacggggagttaatgccctttatgataacaaaaggagtaacttcgagggccgccccttggtcatgcgtctgatgagagacgattgcatcgcttttgagaagaatggggtgaaagaagtgtaccggatacagaagattaacggattaaagaaaaatatcaccctcacaaggcacttcgacgcgaacgtcgatgaccgctatcgaagaatgctgaaggcccagaaagcagagaaggctggtgaagactttgatagcgaggacctttgtgatgacctggttttctcgtcctttggcgcctctagcctatactcaaataaagcccggaaggtgaccatcagtcctatgggggtgctcagggatccaggattcaagggctga

SEQ ID NO: 2735 - RNA, 3267 nt, synthetic construct
  misc_feature 1..3267: note = Cas9 variant
  source 1..3267: mol_type = other RNA
atgaagaaactggtgctcgggcttgacatcggggtcgccagcgttggatggggtattatagatgctgagaacggcgacgtgctggatgcaggggtaagattgttctcctctagggacgcctcagaaaatgagagtcggcgcaccagccgacgtcagtccagaaggttatctcggcgcaagaaacacagaagggaacggatcaagcaactgctactcgcgcatgatatggacgtgtgcgatattgtcaacgagaatccctaccagctgcgcgtgaaaggacttaacgaaaagctggagatctcggagatttatgttgctttgacacacctcgccaagcgaagaggcgtgtcatacctggacgatgtcgtggaagagggtggggcaatcaaaagcgaacatctgaataagaacatggaggagataaaaagtggaaagatgccttgtgaaatccagctcgagaggtttgaaaaatatggccaggtacggggcatgattgagatcaatcaagacactgaagagtcctctttcttagttaacatttttcgtacgagcgattacatcaaggaggccaagaccatactggctacacagcagaaattccacaagcagattactaatgaatttatcgacgagtatattaacatcatggcatccaaacgcgattacttcatcgggccaggaaatgaaaagtcaagaaccgactatggtgtgtacaggacaaacggcgacacctgggataatctttttgagattttgatagggaaatgcagtgtcttcccggaagagactcgggccgctcgaagctcttacgtggcccaagagtttaacctgctaaatgacctcaacaacctgaagatctcctcacttgaaagcggaaaactgagtacatctcagaagcatgatattgtggagaaggtcaaaaattccaagaaattcggcaccaaggacttgctcaaatatatcgcgagcgtttgtgaatgcaagatagagaacattgatggttgtcgcaaggacaaaaatagaaagcccatcatgcacacgtttgaaaactacaggaaagtgcacaatgcactgaacgaggccggggtagatttacggctgtcggaggctgactatgatgaactcatgaagatcatgactcttaattctgagaccctggaaattaaaaagcagtgcaaggagaaattgcctcatctaacagaggactacctgaacgtgtgtctcgtcctgaataagaaaggagccttctccggctggcacgcactttcactgaaggctatgaaattgatgatgccagaactctatggcacttctaagaaccagatgcaaatcattcataccatgcagctggggaaggcctacataaaacccttaaatcagcaaaagtatctgaacagcgaggcgatcctagaagagatttacaatcctatcgccgcacgctccatcagacagacaattaaagtgaccaacgctatactcaagaaatacggaccactggattctgttatcattgaaatgcccagggactatcagacgagcgaggacgagcgtaagatgatcgagaaaatgcagaaggaaaatgaaaaggagaaaaaggccgctcttaaacgggcccgagaagagtacccttttccagatgaggcattcagaaaccacaaggaattggccactaaactgaggctctggtatcaacaggaccagttctgcgtgtactcaggtcgcaagattagtgtcgtggatctggtacggaacccgaatcagtttgagatcgaccacataatcccccaatccgttagccttgatgactctctgaacaataaggtgttgtgtttctcagaagagaaccagaaaaagggccagcagacacctttttattaccataaagggaagagtggaaattggacctatgaacaatacaaactcttcgtcgagaagctgtttgataagaaaaagattagcaacaaaaagagagagttactgctattcgaagaggacatcaataaatgggatgtgaggcgcggctttattgctcgaaacctcgtcgacactcggtacgcgtcccgtgtgatcctgaatagttatcagcagtacttcggtaaccacgaaatggggacaaaggttaaggtggtaagaggcaaatttacctcgcagcttaggaagaaatggaagatattcaaagatcgcaatgagagccattcccaccatgcaattgacgccttgatcgtcgctgccacggcaaacctgcggctctggaagaaaaataagctgggaatttcagatgagggcaaggtgtatgacaaagaaaccggggagatcttaccatttgaaaagctgacagccagtgagtacaacgaaatgatgaataaagagccctatcttaacttcaagactaaattgcaaaacatagagaccaaggttaagtactcttataaagtgagcaagaaagtcaatagaaagatctccaacgacacaatttactcaactagggaacgagatggaatcgactacattgtgggtaaaatcaagaatatatatgatgtaaagacctacaaagaccagtttctcaagcgctataaaaagaacaaagagcagttcctgatgtaccaacacgatcctcagacattcgctattctagaaagcatcatggccacctatccagacgcagagaatccctttctggcgtacaagaaggaacacggcgtgatccggaaatatgctaagaacaaagccggggcaccggttacttctctcaagttcattgatggagccctgggccagaaaatcgacgtcacgtacaagaataaggctgcccttcctaaaaacaagaaagtggtgttgcagtccattaagccctacagagcagatgtctattacgacgagggtaataaaaggtatcatctgataggggttaagtacagtttatttagcttctctaaacaaggctatgtgatcaacccaattgcttaccagaagctcctggagaaggaacagatccactccgagatgaaattttgcttctcactttatcgtgaagatattatcgagagtggagaagaccctgatagcctgacacgctaccggttttggtcgaagaatgagtccggcaaaaacaagatagaggtgaaacccatcgaaaagccaaatttcgaggacagaaaggtaattaccatcactaaaaagattaaaatcttgaacaagtaccagaccgacgtcctcggcaattcttttaaagcccaagaagagaaggatcccaggagcatagagtga

SEQ ID NO: 2736 - RNA, 3267 nt, synthetic construct
  misc_feature 1..3267: note = Cas9 variant
  source 1..3267: mol_type = other RNA
atgaactacaagatgggcctggacatcgggattgccagcgtgggatgggctgtcataaatctcgatcttaaaagaatcgaggacctgggtgttaggattttcgataaggcagaacacccccagaacggcgagtccttggccttacctcggcgcatcgcgcgatctgctcgtagaaggctgcggcgcagaaaacataggctagaacggattcgccgactcctggtgtcagagaatgtacttaccaaggaagagatgaacctgttgtttaaacaaaagaagcagatcgacgtgtggcagctcagagtcgatgccctggagaggaaactgaataacgacgaactcgcacgggtgttactgcaccttgccaagcgtcgcgggttcaaaagtaatagaaagagcgagaggaactccaaagaatcttcggagtttttgaagaatatagaggaaaaccagtcaatcctggctcaatatcggagcgttggagagatgattgtgaaggatagtaaattcgcataccataagcgaaataaactagactcctattctaacatgatcgcccgcgatgacctcgaaagagagattaagctgatctttgaaaaacagagggagttcaataacccagtctgcacagagcggcttgaagagaagtacctgaatatatggagctcccagcgcccgtttgcttcaaaagaagatattgagaagaaggtgggcttctgtacttttgaacccaaagagaagagagcccctaaagcgacgtataccttccagagttttatcgtatgggagcacattaacaagttgaggctcgttagcccagacgaaacacgtgcactgactgagatcgaacggaacttactgtacaaacaagccttctctaagaataagatgacctattacgatatccgaaaactccttaacctgtccgacgacattcattttaagggtttgctatacgatcccaaatcaagcctgaagcagatagagaatatcagattcctcgaactggacagttatcacaaaattaggaagtgcatcgagaacgtgtacgggaaggatggaatacgcatgttcaatgagacagacattgatacctttggctatgctcttactatcttcaaagacgatgaagacatcgtcgcctacctgcagaacgagtatattacaaagaatggcaaacgggtgtctaacttggcaaataaggtgtacgataaatccctcatcgacgaactgttaaacctgagcttttcgaagttcgctcacctatctatgaaggccattagaaatatactcccttatatggagcagggggagatctactccaaagcgtgtgaactggccggatacaactttaccggtccaaagaaaaaggagaaagcacttttgctgcccgtcattcctaatatcgctaacccagttgtgatgagggccctcacgcaatcacgcaaggtagtgaatgctatcattaaaaagtatggcagtccggtcagcatacatatcgaactggcccgagatctttcccactctttcgacgagcggaagaaaattcagaaggaccagactgaaaaccgtaaaaagaacgagaccgcaatcaaacaactgattgagtacgaattgacaaagaatcccactgggctcgatatcgtgaagtttaaactgtggagcgagcagcagggaagatgcatgtattcattaaagcctatagaactggagaggctactcgaaccaggctacgttgaggtggaccatatcctgccctatagtcgctcccttgatgacagctacgccaacaaagtcttggtgctgaccaaggagaatcgggaaaaaggtaaccacacacctgtagagtatctcgggctgggatctgaaagatggaagaagttcgagaaatttgttttagctaataagcagttcagcaaaaagaaaaagcaaaacctgcttaggttgcgatacgaagagaccgaggaaaaggagtttaaagaacgcaatctcaacgatacgcggtacattagtaagttctttgcgaatttcatcaaagagcacctgaagttcgcagacggcgatggcgggcagaaagtgtatactattaacggaaagatcacagcccatctaagatcaaggtgggactttaataaaaaccgtgaggaatccgatctgcaccatgctgtcgacgccgtgatagtcgcatgtgccacccagggtatgattaagaagatcactgagttctacaaagctcgcgaacagaataaggagtctgccaaaaagaaagaaccaatttttccccaaccgtggcctcacttcgcagatgagctcaaggcgcggctgtcgaagtttccccaggagagcatcgaggctttcgcccttggcaactatgacaggaaaaagttggaatccctgagaccagtgtttgtttcacgaatgcctaaacggagtgtgacaggggcagcccatcaggaaaccttacgcagatgcgtaggaatagatgagcagtctggcaagatccaaacggctgtcaaaaccaagctcagcgacattaagctggacaaagatggtcacttccccatgtaccagaaggaatccgacccaaggacatatgaggccatccggcagcgacttctggagcacaataacgatcccaaaaaggcatttcaggaacctttgtacaaaccaaagaagaacggggagccgggccccgtgattagaactgttaaaatcatagacaccaagaataaagtggtccatctcgatggatcaaagacagtggcttataacagcaatattgtacgcactgacgtgttcgaaaaagatggcaagtactactgtgttcctgtctataccatggacatcatgaaggggacactgccaaacaaagccatcgaggcgaataagccctactctgaatggaaagagatgaccgaggaatatacttttcaattctccctatttcctaacgatctggtgaggattgtgctcccacgtgagaagacgatcaaaacaagtaccaatgaagagattataatcaaggacattttcgcctactataaaactatcgatagcgctaccggaggtctggagcttatttctcacgaccggaacttctccttgagaggcgtcgggtcaaagacactgaagaggtttgaaaaataccaggttgatgtgttaggaaatatccataaggtgaaaggcgagaagcgcgtaggtctcgcagcccccaccaaccagaaaaaggggaagactgtcgacagtctgcaaagcgtgtcggactga

SEQ ID NO: 2737 - RNA, 3270 nt, synthetic construct
  misc_feature 1..3270: note = Cas9 variant
  source 1..3270: mol_type = other RNA
atgaccgccttcaagcccaaccctctgaattacatcctcggccttgacattgggatagctagcgtgggatgggcaatggtcgagatcgatgacaaagaaaacccagttagactgattgatttgggtgtgagggtatttgagcgggccgaaatgccgaagacaggcgactccttagcggctgcccgccgactggcacgttctgtgagaaggctaactcggcgcagagcccacaggctcctgcgggctcgccgacttctgaaacatgagggggtcttgaagcccgaagatttcgacgagaatggactcgtgaaacctctgccatatatccccaagcagcctagaaacacgccatggcaactgagggcagccgctctcgatcggaagttaacacccctggagtgggccgcggttcttttgcacctggtgaaacatcgtggctacctatcacagcgcaagaatgaaggtgagaccgacgataaagaactcggggcactgcttaagggagtcgccgacaacactcacgctctgcaggccggcaattttagaacccctgcagagttggctctcaacaaattcgagaaggaaagtggccatattaggaatcagcgaggggattatagccacacattttcccggaaggacctgcaagccgagttagtgctcctgttcgaaaaacagaaggagtttggaaacccatacgtatctgatgaccttaaaaatggtatcgaaaacctgttgatgacccagcgcccggcgctatcgggcgacgccatacagaagatgctggggcactgcactttcgagcccgcagagcctaaagctgccaagaatacatataccgctgaaagatttatctggctcacgaaactgaacaatcttaggattctgaaccaaggaaacgagcggccattgactgatgccgaacgcaccacactcatggacgagccctacaagaagtcaaaactgacttatgcacaggccagaaagttactggatctagacgataccgctttctttaaaggcctcaggtacggtaaggacaatgcggaaagcgcaacactgatggagatgaaagcctaccatgctatcagtcgtgcccttgagaaggaagggttgaaggataaaaagtcccctctgtctctcagcccagagctgcaggacgaaattggaaccgcattctccctttttaaaacggatgaggaaatcactggccggctgaagggctgtttgcagcccgagatactcgacgccctgttaaaacacatttcattcgataagttcgttcaaatcagtctgaaggctctacgaagaattgtgccgctcatggagcaggggaaaaggtatgacgaagcctgcgcagagatctacggagaccatcacggtcgccggaacagcgaagagacactgtatcttcctcccatcccagcggatgagattagaaatcctgtcgtgttgagggctctgtctcaggcccgcaaggtgataaacggcgtcgggcgacggtacggatcccccgcacgtatccacattgaaaccgccagagaggttggcaaatcatttaaggacaggaaagaaatcgagaagcgccaagaagagaatcggaaggatagagagaaagctgccgcagagttccaggaatattttccaaacttcgtgggtgaacccaagagcaaagacatactcaagctgaggttataccgacagcagaattgtaaatgcctgtatagtgggaaggagattaaccttggccgcttgaatgaaaaaggatacgtagagatcgatcatgctctccctttttctcggacttgggacgattccttcaacaataaggtgctggtcctaggcagcgagaaccaaaataaggggaacagaacaccatacgaatatctgaatggaaaagacaactcgagggagtggcaggaatttaaggcccgtgtggagacctctcgcttcccgcactccaaaaagcagcggatcctcctgcagaaatttgatgaagagggtttcaaggagagaaaccttaatgacacgaggtacgttaaccgatttttgtgtaagttcgtggcggatcatatgcaactgaccggcaaagggaagcggcgcgtctttgcctcaaatggacagattacaaacttactcagaggcttctggggtctgaggaaagtgcgggctgaaaatgaccgacaccatgcacttgatgccgtagttgtggcttgcagtactgtcgccatgcagcagagaatcacccgcttcgtgaggtataaggagatgaacgcatttgacgggaaaacagtcgacaaggaaactggcgaggtgctgcaccaaaagacccacttcccccagccttgggagtttttcgcgcaggaagttatgattcgtgtgtttggaaaaccagatggcaagcccgagttggaagaggccgacacacctgaaaaactccgggctctgctagccgagaagctgagctccagaccagaggcagtacatgaatacgtcgctcccctcttcgtgtctagggccccgaatcgcaaaatgagcgggcagggacacatggagaccataaagtcacctaagcgactggatgaaggtatcagtgttgtgagagtcccacttactcaattgaaactgaaggacttagagaaaatggtgaaccgggaaagggagcccaagctctatgaggcactgaaagcccgccttgaagctcataaggatgaccctgcgaaagcctttgcagagcccttctacaagcaggataaggctggcaatcgtacgcagcaagtaaaagccgtgagaattgaacaggttcagaagacaggggtctgggtgcggaaccagaatggaatcgccgacaacgctaccatggtgagggtcgatgtttttgagaaaggcggtaagtattacctggtgccaatctactcctggcaagtggcaaaagggattctacctgacaaggccataatcgcgttcaaggatgaagaggagtggcagctcattgacgatagctttaatttcaaatttcccctgcacccaaacgacttggtagaagtcatcactaagaaagctcgcattttcggctatttcgcctcttgtcaccgaggaaccggcaatatcaacataagaatccatgacctggataacaaggtggggaaaaatggaattttagagggcatcggtgttaagacagcactctcatttcagaagtaccagattgacgaactggggaaagagatccggccgtgcaggcttaagaaacgccctcccgtgagatga

SEQ ID NO: 2738 - RNA, 3270 nt, synthetic construct
  misc_feature 1..3270: note = Cas9 variant
  source 1..3270: mol_type = other RNA
atgaacgtgagatacaagatcggcctggacattgggataaccagcgtcggatgggccgttgtgaatctcgatatccccaggattgaggaccttggtgtacggatcttcgatcgcgctgaaaaccctcagacaggcgagtccctggcattgccacgacgtttagccagatctgcgaggcggcgcctgagaaggcggaaacaccgcctagaacgaattagaaggctcctgatccgggaggggatacttatgaaggaagaactggacaaattgtttgaggaacgtcatgagatcgatgtgtggcaactccgcgtcgaagctctggacagaaagctcaattcagatgagctggccagggtgttactgcaccttgcaaaacggcgaggattcaagagtaaccgcaagagcgagcataattccagagaaaactctactatgttgaaacacattgaggaaaatagggccatcctgtcgtcatatcggacggttgctgagatgattgtgaaggacccgaaatttgcactacataagcgcaacaaaggcgaacactacaccaatacaatcgccagagatgacctcgagagggagatacagctgattttcactaagcagcgtgaatttggtaacatgaattgcaccaaggagttcgaaaacgagtatatcgctatttgggccagccagcggccctttgcgagtaaagatgacatcgaaaagaaagtcgggttctgtacatttgagcctaaggagaaacgagcaccaaaggccacctacactttccaatcctttatcgcttgggaacacattaataaacttagactggtgtctcccgccggaacaaggggcttgaccgatgaggaacgccggctcctgtatgagcaggcattccagaagaacaagataacgtaccatgacatcagaactttactgaggctccctgacgatacctattttaaaggcgtagtttacgaccgcaatatgccacttaagcagaacgaaacaattcgattcctggagttggatgcttaccaccaaatccggaaagtgatagacaaggcctatgggaaaggaaagagctcctcattcctacccattgattttgacactttcggttacgcgctgaccctctttaaggatgacgccgatgtccgtagttatctgcagaacgagtacgaacagaatggcaaacctatgccaaaccttgcaaataagacatatgacaacgagctgatcgaagagttgctcaatctgagcttcaccaaatttgggcatttatctctgaaggctctacacaacatcctcccgtacatggagcagggagaagtgtattcctcagcctgcgagagagctggctacaaattcacgggtcccaggaagaagcagaaaactatgctgcttcctaatattccaagcatcgccaaccccgtggtcatgcgcgcattgacacaagcccggaaggttgtgaatgctattatcaaaaagtacgggagtcctgtatctatacacattgaactggcgagagatctctcccagacctttgacgagaggcgaaaaactaagcgcgaacaagacgagaaccggaagaaaaatgagacagcaatcagacagctgatggaatatggacttaccctgaacccaacgggccatgatatcgtgaagttcaaattgtggagcgagcagaatgggaggtgtgcctactcgctccagcccattgaaatagagcgtctgttagaaccgggctataccgaggtcgaccacgtgatcccttactctcgctccctggatgactcatatacaaacaaggttctagtgctcactaaagagaatcgggaaaagggaaacagaacccccgctgagtacctgggtgtcggcacagaaaggtggcatcaatttgagactttcgtgcttaccaacaaacagtttagtaagaagaaacgagatcggttgctgcgcctccactatgacgaaaatgaggagacagagttcaagaacagaaatctgaacgataccaggtacattagccggtttttcgccaatttcatccgagagcatttaaaatttgcagaatccgacgataagcagaaagtatacactgttaacgggagaattacggcccatctgcgctctaggtgggagttcaataagaaccgtgaggaaagcgaccttcaccacgctgtggatgccgcaatcgtcgcgtgcacaaccccatcagacatagctaagatcactgccttttatcagcggagagagcaaaataaagaattggcaaagaaaaccgagcctcacttcccccagccatggccccattttgccgatgaactcagggctcgcctgagtaagcaccctaaagagtccattaaggccctaaacctgggaaattacgacaacgagaagctcgaaagcctgcacccagtgttcgtctctcgaatgccgaaaagatcagtgacaggcgcagctcatcaggagacccttcggaggtatgttggtatcgacgaacgcagtgggaagattcagactgtggtaaaaacaaagttgagcgagatcaaactggatgcctccggccactttcccatgtacggaaaggaatctgaccctcgtacgtatgaggcgataagacaacggttactcgagcataataacgatccaaagaaagccttccaggaacccctgtacaagcctaaaaagaatggcgagccagggcccattatcaggaccgtcaaaattatcgacactaagaaccaggtggttccgcttaacgatggaaaaacagtggcttataattcgaacatagtccgcgtggacgtatttgaaaaggatggtaagtactactgtgtgcctgtttataccatggacatcatgaaaggcgtcctgccaaataaggcaattgagcccaacaaaccttacagcgaatggaaggagatgacagaggattatactttccagttttccttgtaccccaatgacctcatccgaattgaactgccaagagagaaagccatccggacctcaacgggggaagagataaagattaaggatttctttgcttattacaaaaccatccacagtggaacaggcggtatggagctaatctctcatgacaggagcttctccctgtcaggggtgggcagccgcactctcaagagattcgaaaaatatcaagtggatgtcctgggaaacatttacaaggttaggggcgagaaacgggtggggcttgcctcttccgcacacagtaagaccggaaagacagtgcgtcctttgcagagcactcgcgactga

SEQ ID NO: 2739 - RNA, 3273 nt, synthetic construct
  misc_feature 1..3273: note = Cas9 variant
  source 1..3273: mol_type = other RNA
atgagatggaggctgggcctcgacatgggggccggaagccttggttggtgcgctgtgggcctggatgaccaggggtaccccgattccatcttggcagccggatctcacattttcggcgacggtcgggcgccttcacgcggggatcaacagggaaccccattaggcgtcgagcgacgtgctgccaaggcaatgagaaggcggcgcgacagatttctgggcaggcaggccaagctactcgctcggctgacacttgcagggctgttcccggccgatcccgttcgcgctaaggccttggaactcctggacccttatgtgctgcgagcgagagcactcgatgaggccttaccaccccatcagctgggaagggctttcttccaccttaaccaacggcgtggttttaaaagtaatcgcaagactgacagaggcgtagatgacgaagccgggaaaatagcaatcggaattgataggttgcgggctgccatcgcggccgcagaggctcgaacgatgggcgagttcctgcataagcgcagacagagcgcccctgacgtgaaccagattccatccgtcaggacccggctacgccccgagacaggtgaggaagctaagggggacggatacgatttttatcctggcagagagctcgtggaagaggagttcgacgccatctgggatgcacaggccccacaccatccgtctctgcttactcccgacaatagggctctgttgcacgaagcgatattttaccaacgtcctctcaaagcaccaaagatcggcaaatgtaccctgttaaacaatgagccccggctgcctaaggcccacccactcttccagcgaagaaggcttctggaagaggttaacgctttgcgcattgtgcggcccggggaagtcgccacaaaactaacctgcgagcagagagatctgctcatgctgaagctgaaggacaaagcaaaggtgtcgtttgagactctgaggtcaaaagtattgaagctcgaaccggaggcccgcttcaataaagaaggagagaaccgaacagaactggttggtgatgaggtgtgtgctcagatgagcgccaagacccggtttggcaaagcatgggcgcatttcacggacgagaagcgttgggctatcttaagtagactgattgaagaggaagatgaggaaaggctagacacttggctccgcaccgagcacgggctggatgccgagcaagcacgggccgtcgctggagccagacttcctgcaggcttcggtaggtttggggaaacagctactcgacgcttgatcgccgcgctgcaggccgaggtgatagtgtattccgaagctgtcgttgcagccggcctcggacatcactctgacatgcggaccggcgaggtgctggctgagcttccctactatgggatgacactggaaagacacttgctcccaggaaccggtgacaaggccgatcctgaggaactgaggattggccgtttaacgaatcccactgtacatatcgcactgaaccgcctacggagaattgtgaataggctcatcaaaacatacgggcgaccagagcagatcgcgattgaactgggacgggagcttaagttgaccgacgaggataaacaacgcctgagcagacagaacaataggaaccgggccgacgctgaagcccgatccaagaaactcgcagagctgggccaggctgataatggtgccaacagagcacgcttaaagctgtgggaagaacttaacagggaaaatgccttggaccgtcggtgcatatactcagggcagcaaatcagtattgctatgctctttagcgatgcggtcgaggtggaccacatcctgccctttgatgccactctagacgattctaacaataacagaatactgtgtctcagggagtggaatcgccgaaagagaaaacagtccccttatgaagcatggggccatacagactactggccagatattgctgcccgggccgctaggctgccgaaggagaaacgctggcgtttcgaacccgacgcaatgcagagattttcagccgaggaccggttcatcgcgaggcaccttgttgatacccagtatatgagccgcttggctcgagaatacctggaggccttatatcctgagaagggagaaggcagtgggcatgtgtgggtctctccaggaagactcacggagctgatccggaggaaacttggtctgaacgaattgctccccgaccacaattttgcaggcgtgaagaaccgcctggatcacagacatcacaccattgacgccttcgtagttgctgtgacagataggtccctactgcaagggatcagccgggcatcggccctcgagggagaggaaggccgtgagcgcgtcattgtgcctgaaccatgggacggttttcgagaggcgctgagaactacccttaatacaataactgtctggcataggcaggatcacgggaccgcttctaaggccggcttggcacagggacgggaccagacagccggcaaactgcacaacgataccgcttacgggttaactggacgccaagacacgaagggcaatgatctcgtggtttccagaaaacccctgatgtcacttaagccggccgacatcgaacctgtgccagatgtagcacccattacaaaaggtgtcagggaccgggacctgcgaaaggctctagcccatttcacccaggcgactgaggggaagggatttctccaggccctggagagattcacccgcttgggccctctgcactttaggggtatccggcgtgtgagattaatccagcccctcgcagttattccaataaaaggccctgggggagtgccctataagggctaccttgggggagaaaacttcaggtgcgatgtctgggagatgccagacggcgcttggaaaccggaagtgacaagtatgttccaagcccatcagcctggttggaccagcgctatccgcgcagcctgtcccactgcccggaaggtactttccctgcacaaacgagatatgattgctatcgagagagaagagggggtgaggacattgatggttgtcgcgcagatttggtctaatggacaagtgacgctcgtggagccacatgaagcaggcgacctgaacaagcgcaataaaagcgaggatgacccctttggttacttcatgcctaccgccggcgggctaaagcggctgaaggctagacaggtccgtgttgatgaacttggaagggtgcaggacccaggctttcccgcccggaaagcacgccgaagaactaggcctaaacaggtggattga

SEQ ID NO: 2740 - RNA, 3273 nt, synthetic construct
  misc_feature 1..3273: note = Cas9 variant
  source 1..3273: mol_type = other RNA
atggactggagactgggcctcgatcttggggccaacagcctgggatgggctgcattgaggttagaccgggccggtgatcccatcggcattctggcgatggggtcccgcatattctctgacggacgagatcctaagtcaggcgctagtctagccgtggaccgtagagcagccagggctatgcggcgcagaagggatcggtttaaacagcgccaagcagccctcctgaagtaccttatccgagacggtctgttcccagctgatcaggccgacagacagaggttggcggatgaggacccgtatgcactccgggcccgtgctctggatgaagaactgagcctctttgaaattgggcgcgccttattccacctgaatcagagaaggggatttcaatccaaccggaaagcagaccgaggccaggacgatgaggctggcaagatcgccgtcggggttgaccgccttaatcagcagatggaggagcaaggagcgagaaccttgggtgagttcctgcatcagaggcggcgcgccgcaacagatgctaaccacattccctctgtgagaactaggctacgtcctgaaacgggcgagggggccaaaggagacggctacgatttttatccatcgcgggctctcatcgccgaagagttcgaggaaatatgggcagcccaggctccccattaccctgacaccctgacacagcaagtacacgatcgactttatgagatcatttttcatcagagaccactgagggcgccccaggtgggtcaatgcactttggtcgcaggggaaacccgcctccctaaggcccacccactgttccagaagcggagattactggaggaaatcaatgctctcatgattgtgaggccgggagagatcgcccagcgccttacacccgaggaacgagacaccctgtacttgaaactaaaggataaacggactgtttcatttgcaacactgcgtaagaccctcaaactggacagcgccgctagattcaacaaggagagtgaaaataggacggagcttaagggcgatgaagtggccgcagagctgggcgcgaaaactcgcttggggacccggtggcagcacctctccggagaccaacagtgggaggtcgtgcatagactgatggctttagaatctcaggccgacgaggcagcctttagggattggataagccagacatatgacctgctacctgaacaagctgccgcagtactcggtgctcgactgccacagggccacgggcgcttcggacccactgccaccacaacccttattgattccttgctgcatgaccggacggaggatggcagagttgtggtctactcagaagcggtgcagaggagtggtctcgggcaccacagcgacctgcgtcatgatcgcgacgatgaggacgtgactgagcttccttactatggcgtcgccctggaacggcacatcatgccaggaacagctgagcccaccgatccggaagagatgagaattggcaggttgactaaccctacagttcatatcgggctcaatcagctgcgacacgtggtaaaccggttaatccgcgcatacggacccccaaaggagattgccatagaactggctagagagctaaaactctctgaagacgagaagaaaaagaggaactccgaaaatcgggataatcgactggccgcagagggtagatcaaagaaacttgaggaaatccgccaaagggacaccggcgcgaaccgtgccttgctgaagctctgggaggaactgaatcctgggaacgtgttagaccggagatgtatttatacgggagagcagatcagcatagatatgctgttcagtgacagggtcgaagtggatcatattcttccctttgctcagaccttggacgattctaacggcaataaactcctgtgcctacgcgaggccaaccgagagaagagacggaggtccccatacgaagcatggggtcacacagaccgctggcccgatatcgctgagcgtgccagcagactgcctaaaccaaagcggtggaggttcgaaccggacgcaatgcagcgctttgccactgaggatgggttcctcgctcgacacctggttgacacccaatatcttggcagattggcgcgggaatacctgtcgtggttatatcccggaaggggcgaggggtctggacatgtgtgggtctcccctggtcgcctcacagagatggtgagaaggaaactgggccttaatgatctgttgccagaccacaactttgggggaggcgccgatcagcccaagaatcggctcgaccatcgtcaccacgcaatcgacgctctggtagttgccattgtggatcgcggtatgctacaggccatcgctcgagcatcagggcaagacggcagtgaaggaagagagaggattcatatacctgccccatgggatggcttccgggacgatctgcgcgtcgcggtgaacgggatcattgtcagccacagacccgaccatggaactgtggctaaggccggcctcgcaaggggtcgggatcagaccgccgggcgactgcacaatgacacagcttacggacttaccggcgaaactgatgcaaaaggtaactccatcgttgtgagacgcatcccgttgtctgccattaagaaacctgcggacatagctagggtacgggatccactgttacgtaatgccctcgcagagtttacgaagggcctggacgggaaagccttcgaggctagaatcggaaggtttcatgaacttggccccctgctataccgcgggattcggcgagtcagagtggttgagacactcaccgtgatccctattagggacgccgaaggacgcgcatataagggctacaagggtgatagcaactatcggtacgacgtctgggagatgcccgatgggaaatggagatgtcaggtggtatcaatgttcgacgctcaccagagtactgaacaagcccgtccacaccctgcggccaggaagatcctgtccttgcagcggaatgatatactggcaatcgagcgcaccgagggagaccgagaattagtgagagttgtcaaatttagcgagaagcagttcgctgtggctcccccacatgaaggcggttctctcaaaacaagggatggcaacgccgacgatccgtttcggtatctgtacccttcacccaatacccttaaggggtggcgcgcaagacaggtgaggattgacgagctgggacgagtcttggatccaggcttccccgcccggaagagtgttcgtagaactcgccctagggccgctccagtggactga

SEQ ID NO: 2741 - RNA, 3276 nt, synthetic construct
  misc_feature 1..3276: note = Cas9 variant
  source 1..3276: mol_type = other RNA
atgtacagcaacctcctgttctcctttgacatcggcaccaattctattgggtggtgcgtgttcgcccttgatgaggctggagaaccctatagaatagtcgacctgggtgcaaggatctacgccgatggccgggaccctcagtcaaagacaagtttggcggttgctcgccgagaggcccgtgcaatgagcagaaggcgggatcgctatttaagaaggcggaaagccactctgcgcacgatgattgaatacgggctaatgccaggagacaaggctggccaagaggcagtgctccgagaaaccggtgatagagaagggggagacgagtcctttaacccgtatgccctgagggctcgggccctttctgaaaaactgccccctgcgtacatcggccgtgtattgttccacctcggccagcgcagagggtttaagtcgaataggaaaacagatcggaaggacaacgataagggaaaaattgcactgggtatcgacgagctgactgccgctatgcatcgatcaggcagcccaaccctcggggcctggttagcaatgcgcagagctgaaggacacagtgtgaggctgcgggccggctccgaggtcttcgatgcggagggttatgccttttaccccgaacgctctcttttggaggacgaatttagacagatatgggacgcacaggctgtgcatcaccctgatatcctgacaccagagaggcgtgcccatctattccgggttatgttctaccaacgacccctcaagaaacctctggtggggagatgtagctttaatccagctgagttcaggctttcccgcgcccacccgctgtttcaggagttccggttgtataaggagattaacgacctcgaagtcgtgctgcccgatcagtcacacagaaaattaaccctggacgagaggaatgcactcgtagccaaacttaagacttcccgcaaagctagcttctctgcgctgcgaaagacattgaaactaacccctgatctggtttttaacaaggaatccgaggcacggaaagaactcctgggagacgagatctactcagtgcttgccgatgctaagatgttcggcgcccgttggggcgggtttagcagagcaaggcagtgggagattatcacgcgcctgaaagaagaggaagacccagccagtttgtcttcctggctcaagagcgagttcggactggatgacgaacgggtcactgctatagccaatgcatcgttacccgatggttatggcagactgggggagaccgcgctagcttctatgctcgaggaactgaagacagccgtgattcctgagtccgaagcagccaggctttgcggatacgaccattcaaacttggctaaagagcaagacgagggcctggatactctcccagaatatcaggagatcctggaacgacacattcccccgggtaccggggaccctgatgacatctacgatcttcgcaagggccggatcacaaatcccaccgtgcatattggactgaaccagttgagaagggtcgttaatgccctcatacaccgttttggccgcccacagcggatcgtggtagagctggcaagagacttacaactgagtgaaaaacagaaggatgacgtgaacaggcgaattgctaaaaatacgcgggaggccgaggggcgcagccagaagctaatcgaaatgggacaactcgatactggttataacagactgcttttgaagctgtgggaggaactcaacctggacaaacctgaggatagggtctgtatatactccggcaagcccattgggatcgcgatgttattctctggagaagtggacgttgatcacatcctgccatggagcaaaacacttgacgactcacaggccaataagttgctctgcctgaaaagtgctaaccggcagaagcgaaatagaaccccctccgatgtgcctgagtggcgcgacaggtacgatgaggtcctagcacgtgccgctcggctgccaagaaacaagaggtggcgctttgccgcagacgcgatgcagcaattcgaagccgagggcggttttctcgctcgacagctgactgatacacagtatcttagcagaatggccttggaatacctgtctgcattatatccgtcagaggaagctgacaaaagtggggagctccggcagaggaagcgcgtgcatgtagttcccggccgtctgaccgagcttctgagacggaattggggattgaacacgctcctgcctgatcacaatctaggcgaaatggcccaagagaaaaacaggcgcgaccatcgacaccatgcaattgatgccgctgtgatcgggaccacaagcagatccctgctccagcggatgtctggagcggccgcaaggctggacgatgtcgctttcgacgatcttgtgcgcactgtcgtgaaggacaatccaccctggcctggttttagagaagagttgctggccgccattggcagggttaccgtgtcgcacaaaccagaccacgggacagtaagccgggctgcatacgcccagggaaagggccagactgcgggtaagttacataacgataccgcttatgggctcacaggcctggtcgacgccaaaggaagtccccttgtggttcgtcgcaagccgttcatggcactggaggtgaaagatatagcctcaatccgagacaccgaactacaaagtgctctctacggcgcaattgggtctctgactgagaagaaagccttgcaggaagcgctgatcagatttagggatacgcaccctcagttcaagggaatccggcgcgtcagagtgttagagacactcagcgtaattccaatagtggacagggatggcaaggcttataagggttacaagggggacgccaattaccggtatgaagtttgggagaccctggatggaaaatggcatactgaggtcgtgtccatgttcgacgcacaccagcccggctggcaatcaccttttcacaagcagaaccccgccgctcgaagagtgcttaaactgcagcaaaatgatatggtcgcctacgaacatccagcagacggttataccatcgctcgcgttgtgaagttcagcaacgacaaaaggatttactttgcctctcaccgggagtccggcagtttgaaggcgcgtgatgccgacaagggggatcctttcagctattttgcaaaagctaataacggactcagagacatcaagtgtcgccaggtgaggattgatgccgctggccggatcttcgaccccgggccacaggatcgagaaacaagacaggcaaacaaaggagtatga

SEQ ID NO: 2742 - RNA, 3279 nt, synthetic construct
  misc_feature 1..3279: note = Cas9 variant
  source 1..3279: mol_type = other RNA
atggcctacaccatgggcatcgacgtggggattgctagctgcggatgggcaatagtcgatctggagagacagaggatcattgacatcggtgttcggacattcgaaaaggccgagaaccccaaaaatggcgaagcgctcgctgtgcctcgccgagaggcccgttcctctagaaggcggcttcgcagaaagaaacacaggattgaacggctgaagtatatgtttgtacgcaacgggttggcagtggatatccaacatttagagcagactctgcgatcacagaatgagatagacgtctggcagctaagagtggatggactcgacaggatgctgacgcaaaaagaatggcttcgggttctgatccacttggcccagcgtcgcggcttccagagtaacagaaagaccgatggtagctccgaggacggacaggtgctcgtcaatgtgacagaaaacgataggctgatggaggagaaggactaccggactgtagctgaaatgatggttaaagatgagaagttttctgaccataaacgaaataagaacgggaattatcacggcgtggtctcgcgcgcatcactgctcgtggaaattcataccttattcgagagccaaagacagcaccacaactttctggccagtaaagatttcgaacttgagtacatcaatatttggtcctctcagaggccagtggctacaaaggaccagatcgagaagatgataggcacctgtacatttttgccgaaagaaaagcgggcccccaaagcgagctggcatttccaatattttatgctgctacagactattaaccacatccgcattaccaatgcacaggggacgagacctctcaacaaggaggaaatcgagcaagtcgttaatatggccctgactaaatccaaggtgtcataccatgacatcaggaaagtacttgatctgagtgaagagtatcagttcgtgggattggactacggtaaggaggatgaaaagaaaaaggtcgagagcaaagaaaccattataaagctcgacgattaccacaaactgaacaagatctttaacgaggtggaattagctaagggcgagacatgggaggccgttgactatgatactgtggcatacgctctgaccttctttaaagacgatgaagacattcgtgattatctccagaataagtacaaagactctaagaaccggcttgtcaaaaatgtggccaacaaggagtatacaaatgaactgatcgagaaggtatccaccttgtcattccgaaaagttgggcacctaagcctgaaggcgctcagaaaaataattccattcctggagcagggaatgacgtacgacaaggcctgccaagcagctggctttaacttccagggtatcagtaaaaagaagaggtctgtggtccttcccgtgatcgatcagatttccaatcctgtcgtgaaccgcgccctgactcagacacggaaagttatcaatgctttgattaagaaatatgggagcccagaaaccatacatatcgagactgccagagaactctcgaagaggtttgacgagcgcaaaaacattacaaaggattacaaagaaaatcgagacaagaacgagcgggcaaagaaacacctgtctgagttaggaatcatcaatcccaccggcctggatattgtgaagtacaaactatggtgtgaacaacagggccgttgcatgtattccaaccagcctatatcattcgagagactcagggaaagtgggtacacggaggtagaccatatcattccatatagccgctccatgaatgattcttacaacaaccgggtcctggtgatgaccagagaaaatagggagaaaagcaaccagacaccgtatgagtacatgggaaatgacactcaacgatgggatgaatttgagcagcgcgttaccacaaacccccagatcaaaaaggaaaagcggcagaatcttttgctgaaaggtttcactaacagaagggagctcgaaatgctggagcgtaatcttaacgacacccgccacattacaaagtatctgtcacattttatcagtaccaatttggagttctcccctagcgataaaaagaaaaaggtggtcaacacttctggccggataacgtcacacctcagaagtaggtgggggctggaaaagaatcgagagcaaaacgacttacaccatgccatggatgctgtggtaatcgcggtgacaagcgactcctttattcagcaggttaccaattactacaaacggaaggaacgcagagagctgaacggagacgataaattcccactaccctggaagtttttcagggaggaagtcatcgcacggctctctcctaatccaaaagagcaaattgaagccctgcccaaccacttttattcggaggacgaacttgctgatttgcagccgatcttcgtgagccgaatgcctaagagatccataactggcgaggcccatcaggcacagttccgcagggtggtcggtaagaccaaagaggggaagaacattacagccaaaaagaccgctctggttgacatctcatacgataaaaatggcgactttaacatgtatggacgtgaaactgatcccgccacatacgaggcaattaaggaacggtatctcgagttcggcgggaatgcgaaaaaggcttttagtacggacctgcacaagcctaaaaaggatggaaccaaaggtccattaatcaagtctgtgagaataatggaaaacaaaactctggtgcaccccgtaaataagggcaagggggtcgtgtacaacagctccatcgttaggacagacgtgttccaacgcaaagagaagtattaccttttgccagtctacgtgaccgatgttacaaaaggaaagctccccaataaagtgattgccgcaaagaagggctatgacgattggatcgaggtagacgactcatttactttcctgtacagcctatatcctaacgatctgatttttatccgacagaatccaaagaagaaaatatctctcaagaaaagaattgaatcccatagtatcagcgactctaaggaggtccaggaaatcctgacctactataagggtgtggattcctcaacggccgctattgagttcatcacccacgacgggagttactatgccaaaggcgtgggagtccagaaccttgattgttttgaaaagtaccaagttgacattttgggcaattacagcaaagtgaagggggagaaacggctggagttagaaacatcggataacaatcataagggaaaggacgtaaactccataaaatctactagcaggtga

SEQ ID NO: 2743 - RNA, 3279 nt, synthetic construct
  misc_feature 1..3279: note = Cas9 variant
  source 1..3279: mol_type = other RNA
atgaagtacagcatcggcctggacattgggatagcctccgtgggatggtctgtcatcaacaaagataaggagagaattgaagacatgggtgttaggatcttccagaaagctgagaatcccaaggatggctcaagtctcgcaagctcccggcgcgaaaaacgagggtctcgtagaaggaaccggcgcaagaagcacagacttgacaggattaaaaatatcctgtgcgagtcgggattggtgaagaaaaacgaaatagagaagatctataaaaatgcctacttaaagtcaccttgggagctgcgggctaagagcctagaagcgaaaattagtaacaaggagatcgcccaaattctcctgcatatcgcaaaacgccgaggctttaagtccttcagaaaaaccgataggaatgccgacgatacaggtaagttgctgtctgggatacaggaaaacaaaaagattatggaggagaagggatatttgactatcggcgacatggtagctaaagatccaaagtttaatacgcacgtgcggaacaaagcaggcagctacctcttctccttttcacgtaagctgctggaagacgaggtccgcaaaattcaggccaagcagaaggaactcgggaatacccatttcacagatgacgtgttagagaaatatatcgaagtttttaacagtcaaagaaatttcgatgagggaccgagcaagccctctccttactattccgagatcggtcagattgctaaaatgataggcaactgtacttttgaatcaagcgagaagaggaccgccaaaaatacatggagtggggaacggttcgtgtttctgcagaaacttaacaacttccgaatcgtcggattgtctggcaagcgcccactgaccgaggaagagagagacattgtggagaaggaagtatacctaaagaaagaggttaggtacgaaaagctccggaaaatcctgtatcttaaggaggaagagaggtttggtgacctgaattactccaaggatgagaaacaggacaagaaaactgaaaagacaaaattcataagccttattgggaactataccatcaagaaactcaatctgtcggagaagttaaagtctgaaatcgaggaggataaatccaagctggacaaaattatcgaaattctcacgttcaacaagtcagataaaactatagagagtaatcttaagaagctggaattgagcagagaggacatcgaaattctactgtccgaggagttttctggaaccctcaacctgagccttaaagcgatcaagaaaatcctgccctacttggaaaagggcctctcatataatgaggcatgcgaaaaagccgattacgactataagaacaatggcattaagttcaaacgcggggagctgttacctgtggtcgataaggacctgatagctaacccagtggtgctacgtgccatcagtcaaacacggaaagtcgttaatgcaattatccgaaagtacggaactccccacaccattcatgtggaagtagctagagatctcgccaaatcctacgacgacaggcagacaatcataaaggagaacaagaaacgcgagctggaaaatgagaagaccaaaaagtttatcagcgaagagttcggtattaaaaacgtgaagggcaaacttttgctgaagtatcggctctaccaggaacaggaggggagatgtgcgtattctaggaaggagctgtcacttagtgaagtcatcctggatgagagcatgacggacattgatcacatcataccttactcccgctctatggacgattcgtatagcaataaagtgttggttctctccggagaaaaccgaaagaaatcaaacctgttaccaaaggagtactttgaccggcaaggccgtgattgggacactttcgtgctgaatgtcaaagccatgaagattcacccgagaaagaaaagtaacctactcaaggagaaatttacaagggaagataataaggactggaaatctcgcgcactgaacgatacccggtatatcagcagattcgtggctaattaccttgagaacgccttggaatacagggacgattcccccaagaagcgagtatttatgattcctggtcagctgactgctcagctccgcgcccggtggagactgaataaagttagggagaacggggacttacatcacgcactggacgccgctgtggtcgcggtgacagatcaaaaggcaatcaataacatatcaaatatcagccgttataaagaacttaagaactgcaaagacgtcattccatctatcgagtaccatgccgatgaggaaaccggcgaggtgtatttcgaagaggttaaggacacgcgctttcccatgccttggtccggattcgatttggaactccagaagcggctggagagtgagaatccaagagaagagttttacaacctactgagcgacaaaaggtatctcggctggttcaattacgaagaggggttcattgaaaagctgcgacccgtgtttgtatctcggatgccgaaccgcggagtcaaaggtcaggctcaccaggagaccatcagatcctcaaagaaaataagtaaccaaattgccgtgagcaagaagcctcttaattcgatcaaattgaaggatctggagaaaatgcagggcagggacacagatcggaagttatatgaagcactcaaaaaccgactggaggaatacgacgataagcccgagaaagccttcgctgagccattttacaagcctactaattccgggaagagaggaccccttgttcgcggcatcaaagtggaagagaagcagaacgtcggtgtgtatgtaaatgggggccaggcctctaacggaagcatggtgaggattgacgttttccgtaaaaatggcaagttttacaccgtcccaatctatgtgcaccaaacactgttgaaagaactccccaaccgggcaattaatgggaagccttacaaggattgggacctgatagacggatcattcgagtttctatatagtttctacccaaacgatctgatcgaaattgagtttggtaaatccaagtctatcaaaaatgacaacaagctcactaaaaccgagattccggaagtgaatctgagcgaggtccttggctattacagagggatggatacatccaccggagcggctactatcgacacgcaggatggcaagatacagatgaggatcggtattaagacagttaaaaacatcaagaaataccaggtggacgtgttggggaatgtatataaggtcaaacgcgaaaagcgacaaaccttctga

SEQ ID NO: 2744 - RNA, 3285 nt, synthetic construct
  misc_feature 1..3285: note = Cas9 variant
  source 1..3285: mol_type = other RNA
atgaaaagcaccctggccatcgcttccatttcttcactcggctgggtgatagagcttggggaaaacagaatcatgaggctgggattggacattggtagtacaagcatcggctggtggatttacgagactacggatgggcagatcacctccgtcatagacggaggcgttcggatcttctctgatggtcgcgaccccaagtcgaaggggtcattagcagtggatcgacgtgtagccagagcgcaaaggcggcgcagagacaggtatctgcggcgcaaagctgccctaatgaagcgaatggcagaagtgggactcatgcctagcgatccaaaacaggccaagcagctggaggctcttgacccgtacgaactgagagcaaggggcttggatgagacactcgagctgactgaactgggccgggccctctttcacttaaatcagcgtcgcgggttcaagagtaacagaaaaaccgacgctggagataatgagtccggtaagattatcgacgccacagcgaggctggattgggcaatgcgggaccatcgagcccgcacctatggcgaatttcttcacatgagaaggcaaaaagctgacactccccggacaacccctgccgtccgcacgagattgactattgcagctagggatggggccgagaaggaggaatctggatacgacttctatccagatcgtcagcatctgcgggacgagtttgatgcgctatgggaagcccaggcagagtaccacggcgtgctcaccgaagacctgcgagatgagatcggtacaataattttccatcagagaccccttaaaactcctaaggttgggaagtgcctgtttaccaacgaggaaagggtggctagcgcccacccattgaatcaacgccggatcctcgtcgagacagtgaacgctctgagagtagcccagttaggagaagttgcaagggccctgaccctcgaggaacgcgacacgattcttcacgctctggataataaagcgcatactaagtccttgtcaggcatgagtatcaaactaaaggcactgggcaaagtgatcaagctccgaagcgggcagtatttcacactggagaccgccaaccgggacgctattgcctgtgatcccgtccgtgcatctctttccaaacctgacagaataggatcatactggagcactctggaccacaatgcccagtgggaggtggtgaacaggatccgcgctgtccaaagtgatgccgaccatcgggaattggttgcatggctcgtgtctcagcacagactggcggctgagcacgccgaaggtgcagcctacgctccattaccggatggctattccaggctggggattacagccaccaagcgaatcctagcagctctcgaggccaatgtaataccctacagcaaggcggtggaatcgtgcggatggcatcactctgacgagcgcacgggcgaggtcctggatcggcttccttattacggtgaaattttggacagacatgtgatcccagggacctatgatgactccgatgacgatatcacaaggtttggccgtattactaaccccaccgttcacatcggactgaatcagctccgccggctggtgaacagaattatagaggtccatggcaaacctgacgaaatcgtggtagagcttgccagggatctgaagttgtcacaagaccagaaagctgacgttgagcgaacaattaagaaaaatactcaggcagccatccggcgcggggaaaagctcgaggaaatgggagtgccaaacaccggtggcaacagaatggtcctgaggttatgggaggatctgaatgacgatgacgtgatgaagcggttctgtccctacacagggcagcgaatcagtgctggaatgctatttgatggcagctgcgacgtcgatcacattctcccgttctccagaaccctggacgatggttttactaacaaaacgctttgtttgaaggaagccaatcgcaaaaagaggaactatgcacctcacgaggcggccgagaaagggctgctcgaccgtgatgctatggactctgtggccaagtacctgcccgataataaggcatggcggttcgctccagacgccatagaaagattcgagggcgaaagggactttacagcacgcgccttaaaagatacccaatacctgagccgacttgctagaacttatttggacgcgctctacgatggaggcgacgataagtcacatgtttgggtggtacctgggcggctgaccgagatgctaaggcgccactggggactgaacggtctcgaagccctggcagacagtgatgagaaaacagtcaagcgtaaaaatagaaccgaccatcggcaccacgctatcgatgccgccgtggttgctgcaactgacaggtcccttattcagaagatcagcaagattgccgcgtctgatgagcaggctggcgccgaagacacattgaaatcaacgcccccaccctgggacagtttccgcgatgacatcgcagcccagctgcaaaacataaccgtgagccatcgagctgatcacgggagaactgactccttagcaaagggacggggcgaggatacaacctctggtgccctccatgaagcgacagctctggggatcattgacgagactcacgtcaccgtgaggatccctattgaatcgcttaaaagcggccatctgatcgagggatcccgcaatggctatataagagatccatacttgagggaccagctcacgctggccaccaagaacgggtcagataaagactttacaactgtactacagaagttctttgatcggagtaaacgttatggaggcacccgccgagtgagaattatcaagacactgcaggacactgcaaggatttctgttccgcacaatgcccccatcaaggcttacaaaggtgggagcaaccacgccttcgagatatggcggctccctaatggaaagatcgaatcccaagtcattaccacgtgggagcatcacaacctgacagaaccaaaacgcccccatcctgcagctaagagaatcattaggcttcacaaaaccgatatggtggccatcgagcgggacggcaagactgtgatatgctttgtccagaagacagacccatcaaatggtgcgttcttggttccccattttgaggccaacgcagatggccgaaaaagaaagaacgaaccggtggagtggtatcagatgagcgctaattctctgattaaagccgacttacgcagggtgggggtagatgaaatgggacgggtccgtgaccctggcccaccccctatcagatga

SEQ ID NO: 2745 - RNA, 3285 nt, synthetic construct
  misc_feature 1..3285: note = Cas9 variant
  source 1..3285: mol_type = other RNA
atgaagtacagagtgggcttcgacctggggaccaacagcctcggatgggccgtcgttaggcttaatgcttccggtgagcccgatcggatcgaagtggcaggctctcgcatattttcagacgggcgagagcctaaaagtggagccagcctggcgggcgctcgtagagatgccagggcaatgcggcgcagaagggaccggttcaagcagcgccaagccgctttgattaaatatttaacacaggcaggatttttcccagccgatgaatccgagcgaaaggctctgtctgccctagacccgtacgaactcagagcgagggcactggatgaggcccttcccctggctcacttggggcgggccctctttcatctgaaccagcgtcgcggattcaaatcgaatagaaagactgacaggggcaagaacgatgacacgggcaaaatccggattggggtagcacgactgtatgagcagatgcgcgatgctgacgccagaaccctcggagaatttttacacaagaggcgggcggccgcatcagatcctaatgctatcccacatgtgcgcacaagaattgtcactctggccgctgaggacggtaaagccagcgacgtgtacgatttctatcccgacaggcaaacccttgaagaggagtttgaagcaatctgggaggcccagacaagtcaccatcctgaggctttgaccgaggaacgtcgggcgcagttctacgagataatctttcaccagcgaccactgaagcaacccaaaattggcttctgcactctactccctccagagaagagactgccgaaggcacaccccctttttcagaggcgccggctgttggaagaggttaacgccctcagaatcgtgctgcctgggaaagaaacaagggctttagagaaggccgaacgcgatgcactgctctccaaacttaatcagcgaaagaaagccgcttatgagtctctgcggaaggccttgaaactagacccagatgcacgtttcaacaaggagagcgacaatagagaagatatgattggagacgagatcgcggctgaaatggcccataagtccaggttcggcaaagtctggctgggtatgtcagcagaggcccaggctcaagtgatagaacgcctccgggggctggagagtgatgccgacgcagatgactttgaggcttggcttagagacgatcacggactggcccaggaacaggcgaaggccgtaaccgctgcaaacttgcccgagggctacggcaggttcggggaaacggccactcgaaaactcattgctgccctggagcaagaggttatcgtgtacagcgaagcagtccagcgcgcgggattaggtcatcactctgacctgcgggatggccaggtgtggaccgacaagaaagggaatcctgccctaccatattacggagctgtgctcgagagacacattgtccccggcacagccgatccgaacgaaactgacgatgcactgaggatcggtcgtcttaccaatcctacagttcatatcgggttgaaccagctgcgccgggtggtaaatgctctcatgagaaggtatggccaaccccaggagattgccatagaactggcacgagagcttaagctgtccgacgatcggaagaaagagatcaacacccgcaacagagaaaataggaaggccgctgagaaacggtcacagaagttgcgaaacattggacaggcggacaaaggcgggaatagagccctcctgaagttatgggaagaactgaacccagaaaatgtgctagatagaaggtgtgtctacacgggacgtgtgatcagcatagacatgctctttagtggtgcagctgaggttgatcacattctgcctttctctgtgtcccttgacgacagcaacggcaatcggatcttgtgcctgagagaggtcaacaggatcaagcgccaacgaactccctgggaagccagagatgacctccgggcccattttgggccagatgctggatgggaggcaattgccgcgagggctgcccgcctgccccgtgaaaaacgctggcggttcgagcctgacgcagccaataggtttgatgctcagggcggtttcttagcacgccacctgacagacacccagcatctttcgcgattggccagatcttatctctccgcgctgtacccagaaactggggagggctcaggacacgtgtgggtaagtccgggccggctaacagagatgctgaggcgcgcttggagcctcaaccaccatctgcccgatcacaatatcgccggggcagccaaccagcctaagaatagaaaagaccataggcaccacgctattgatgccatagttgtggcacttgctgaccgggccatgttgaaccgtatcgcgcgcgaatccggaaaggagggtcatgaagccgcaggccgactggtcgcttctattccagagccctgggaggggtttagcgatgaagtgggtagagccgtcagggctatcaccgtgtcacaccggcctgaccatggcacggcaagtaaagccggtcgcgccaaggataaggacgctaccgcggggagattacacaatgagacagcatatggcctcactggagaaaaagacgccaggggcctggatatcgttgtgacccggaagccactttccgctttcaaaaagagcgccgacctggatgcaattcgagacgatgacttgaaacaaaagctcaaagcctgggctgcggggaaggagggaggcgcctttgaacaggcaatgagatctttcggtgatcccgagcgcgggccgaggtcacatcctggactgcggcgtataagagtaacagagccactaagtgtcatccccattagggaccgcgatggccggccttacaaggcttacaaaggtgacagcaactatcgatttgatatctgggaactgaagactggcaaatggaaggacgaggtggtttccatgttcgaagcccacagacccaactggacctctccaattagggcagggaatcctacagcccgcaaagtgctctcggtccggcagaacgacgtgatcgctatagagagagaaaatggacccgagctgatgcgtgtagtgaagttcagcgccggctcccttgcgttggcaccaccgcaggaggccgggtcactgaaggctagggatgccgacaaaaacgatccttttaagtacgtttatggaagtccctctagcttacaacggtggaaagctcgccaggtccgaatcgacgaactcggcagagtgttcgatccaggttttgcagtgaggtcccggcgctcaagcgagtga

SEQ ID NO: 2746 - RNA, 3291 nt, synthetic construct
  misc_feature 1..3291: note = Cas9 variant
  source 1..3291: mol_type = other RNA
atgaagaacatcttcagctttgacattggcaccaattccatagggtgggccgtgctggctctcgatggaaacggtgaccccgtcagaatcgcagatgccggcgttaggattttctctgacgggcgggatcctaaatcaaaggcgagtcttgctgaggcccgccgaatggcacgtgccatgagcagaaggcgggaccgcacactgagaaggaaacgggctactttgcgcacgttagcagaaatcggactgatgccagatacctcctctgcccgacaggctcaactaagagagacatcggacccgaagtcaggcagcggtcagctcactaggaatccctacgccctgcgggcgcttgcactggaagagaaattgcctctctttcacattgggcgtgccctgtatcatctgggacagcgcagaggcttccagagtaacaggaagaccgatcggaaggacaatgataaaggcaagatcgctctcgggatagaagagttacacgccgcaatgcgacaagacggagctcagacatacggtcagtggctggcccgcagacatgcgcttggccaggccgtgaggttgcggtccggggcactggatctagagggagaaggctatgctttttacccagagcgcaaactcctggaagacgagttccacagaatctgggaggcccaagctaggcattatcccgacattcttacccctgaacgtcgggatcacctgtttactgtaatgttctttcagcgaccattgaagaaacccaaggtgggtaagtgctctttcaacaatcaggaggaaagactcagcaaagcccaccctctgtttcaggagttcaggttatacaaggaagtcaacgagctggagatcgtggaaccagacctcacacataaaaagctgaccctggatcaacgcaatgcattggttaaaaagctacaggtgtcccgggaggcctcatttgctgcgctgagaaaagtcctcaagctgaggccggaccagcgccttaacaaggaaagtgagagccgaacgaaactgaaggggaatgaagtgtatgcagtattgtctgataaaactcggttcggaccccgttggggcaccttctcccaagccgagcagtgggctattatcgagagactcaaggaagaggaagaccctggcaggctgtttgcctggttacgctcagcattcgggatagagggagaacaggccgctgatattgccaacgttcaccttccagagggtcatggccggctagggaaaacagcactcgaggcgatgctggaggaacttaaggctgaagtgatcactgaggccgaggcagccaagagatgtggatacgaccacgctaggttgggcggtgggagcgatgaaggcgagcccgaactgcctccataccaggagattctccaacaccgaatcccgcccggaaccaataaccctgacgatccctatgacatcgaaaaaggccgctttacaaatccaaccgtccatattgccctgaaccagcttcggcacgtgatgaacacgctgataagaaggtacgggaagcctgcacagatcgctgtggagttggcccgtgacctcaaactgagtgagcgccagaaggaagaggtcaatcggactattgcgagaaacacaagggatgccgaacgacggggaaaaaccttagaggaaaatcgcatccccaacactggttataatagaacactgctaaggctctgggaggagctgaacccaggcaaggttgaagaccggtgctgtatatacaccgggaagcccatttctatctccatgcttttcagcggagaggtggatatcgaccatattttgccttggtcgcgaacgctggatgactctcacggcaataaactcctgtgcttaagagaagctaaccgcgtaaagaggaatcgtgcaccagccgatgtgaccgagtggcgggacaactatgatgaaatcctgtccagagctgccaggcttccgcaaaataaacgcgaccgatttgcacccgatgcgatggagagattcgagaaggccggtgggtttttggctcggcagctcacagacactcagtacctgtcaaggatggccctagaatatctggcatgtctcttccctgctgaggaaatggatggctttggagagctgcgccgtcatagatacattaacgtctgcccaggccggcttaccgagatgttgaggcgcaattgggggctgaacagtatattaagcgactcccagctcggagaaacagcccaagagaaaaatcgaaaggaccacagacaccatgcaatcgatgccattgtgatcggtgttactggccggtctctgcttaacaggatcagctacgctgcggggcgcctggaagcccagcagttggagaccctcgtgaaggaagcagctgccacaaacaaaccctgggacggattcagagaggatgtcgccaaggtggtaggcggtattatagtttcacacaaacctgaccatgggaccgctggcaggaaggcaaaagatccagcccggcagcaaactgcgggacgtctgcacaatgacacggcttatggcctaacaggggagaccgatgcccgcggaaacactatcgtggtccgaagaaagccctttctgagtctcacctccaaagacattccgagcatcagggatgaagcactgcgggccgtgcttgagcagcacttgcgcggcattcctgacggtaaggctttccaggcagccctggatgcgtttagaaagcaaaaagggttccatcactaccatggaatcaggcacgtccggttaacagaaccactctctgtgataggcatcaaggaccgagatggtaaagtttataagggctacaaaggggacgctaatcagagatatgacgtgtgggagaccctggatggaaagtggcatgccgaagtagtctcaatgttcgacgcacaccagcccggctggcagagtcgctttcacgccgagaaccctactgctaggcgggtgcttcgtctgcaacaggatgacatggttgccctaaatgcacccgatgggggaagactcctggtgagggtcgtgaagttccgccagaacggccagattacatttgctggtcataatgagagcgggaacttgaaagcccgggacgcggcctccaatgaacaagatccattcaagtacatctctcgaatggcatcgagcctgaaagactgtggatgcagacaggtaaggattgatgctacgggccaggtgtttgaccctggtccccaggatcgcgcctcccggttacaaaagcagtcaaaaagatga

SEQ ID NO: 2747 - RNA, 3294 nt, synthetic construct
  misc_feature 1..3294: note = Cas9 variant
  source 1..3294: mol_type = other RNA
atgaagaaacagccccaaagatacatcctgggactcgaccttgggattgccagcgtgggatgggctctgatattggtcgatggtgcagagaaccctgttggcttactggactgcggggtgaggaccttcgaacgggccgaggtaccaaagacaggagattccctagcgctcgctcgccgacaggcccgttctgtgagaaggctgatccggcgcagagcacacaggcttctgcggttgcgccgactcctgaaaagagaaggcattctgtcagccgctgactttaatagtgatggtctcccgaacttacccatcgacgcatggcagctgagggtcgccgggcttgagcggaagttgactaatcaggaatgggctgccgtgctgctacatctcgttaaacaccgtggatatctgagccaacgcaagtccgagacgcagaccgagaacaaggaacttggcagactgttggcgggcgtggcagaaaattctaaactcctgtcggaatcaagcgagcagtacaggactcctgccgagttagctgtcaagctgttcgccgaacagagtgggcatctccggaacaaaggaggtgagtatacacacacctttaatcgacttgatctgcaaaaggaattgcatctactgttcgagcgccagtacgcactcggcaacccatttgcttccgccgaactgcagtctaaagtggacgagcttctgatgacacagagaagcgcgttgcaaggggaggccgtactcaagatgctgggaaagtgtaccttcgaaccctccgagtataaagcagctaagaatacttactcagccgaaaggtttatttggttaacaaaactgaacaatctacggatcctctataacggcgaggaacgcgctctggatgagggtgacagaaagaaacttttggatgagccttacaagaaagccaagctgacctacaagcaggttaggagtatactcaatctgccagaaagcgcagtgttcaaagggcttcgttatggaaaggactctgatggcctgaaagccgagaacggcacgttgatggaaatgaaggcttaccacaaaatccggactattctcgacaaggcggggctgaagggagagtgggaaaatcgaatcagaaaccccgagattttagacaaaatcggtaccgcattttccctgtataagacagatgaggacatacaggccgctctagccgatctcaggctgcctgaaaacgtccttgacgcattgctggccggcctcaatttcgataaatttattcaactgtcattaaaggctctgcgcaacatccttccattgatggagcgggggattagatacgacgaagcctgcaaagaggtgtatggagatcacagggcactcgcggagagcaagaatcaggtgctgctaccgcccatccctgctgacgaaatccgcaacccagtcgttctgcgaactctcacccaggcccggaaggtgattaatgcaataatccgtagatacggcagtccccagagggtacatattgagacagcccgcgaactgggtaaatctaagcaagagcgggataaaatcgacagaaagaacaaagaaaatcagaacgataggaatcgacttgcttccgacatacgcaagcacttcaactttgagcctaccccaaaggacattttgaaactgcggttatatgagcagcagcatgggaagtgtctctacagcgatctgagagaagagaaaggcgaatgcctttacacgggaaatgtgatcgagctgcacaggttgttcgaagacggctatgtcgagatcgatcacgccctccccctgtcgcgtacttgggacaactctctaaataacaaggtgctggttctcaaatcctcaaatcaaaacaaggggaacaaaacaccgtacgagtggctggatggagcaaataacagtcgccggtggagagagttccaggctagggtgcagggttgtcattttccttatgtcaagaagcagcggattcaaaccgccaaacttgacagcaaggcggagcagggcttcttggaacgaaatctgaacgatactcgctacatctccaaatttatgtgccagttcattacagccaatttaagactcgctgagacctctaacgcactgatggaagaggtggccggggagaatccctattggaaggaaaggaaacggcagcgagtatttgctccaagcggatcaataatcgcccttctgagaggcctatggggtctcaagaaggttcgcgaggacaacgataggcaccatgcactggacgcgattgtggtcgcctgtagtacggtgtccatgcaacagaaaatcaccaaggctatgcagcgtcgggaaacattggagactgtcgatagcgagaccggggaagtgaaaacaagaatccctcaaccctgggacttctttaggcaggaggttatgattcgcgtgttctctgattcaccacgagaggaactggccgaaaagttaaatagtagacccgaggcactccacgactttgtaagccctctgttcgtctcccgggctccaaacaggaaaatgactggccagggacatcttgagaccgtgaagtctgccaagcgcctgtcggaaaatataagcgttgtgcgtaaaccgttgacagcactcaagctgaaagacatcgagaacattgtcggctaccccgatagagaacctgccctatatcaggctctgcgggagaggcttctcgcgcacaaggacgatccagtgaaagcctttgcagacaagcccttctacaagcctgctaaagatgggggacaaggttccctggtaaaggccgtgcgcatcattgaaaataccaaacacggcttgaagatccgaaacgggataactgacacgaatggagatatggttagaacagacgtctaccagaaaaccgataagaaaggcaagcggcagtattttatcgtgccagtgtacgcctggcaggtcgagaagaacgagctgcccactgttgactgcaaaggttatgaaattgatgacaactacgagttctgtttctcattatataagtacgatctcatcgaaattcaaaatccgaacgacatcaatcaggagctgagggcttattacataaactgcgacagttctgatgggcgcttttggcttgcataccatgacaaaagcgccaaggaacagcagttcagaatttccacccaaaatcagcctatcattaaaaagtatcaggtggatacactgggcaaggagatcaggttgtgtaaagcggagaagcggaccgctctcaacggcaaaaagaaaaagtga

SEQ ID NO: 2748 - RNA, 3294 nt, synthetic construct
  misc_feature 1..3294: note = Cas9 variant
  source 1..3294: mol_type = other RNA
atgggcaagggggacatcctgttcagctttgatattggaaccaactccataggttggtgcgtgttcgccctctctgacaatggcgatccctgtagaatccttgacgctaacgcaaggatttttgccgatgggcgggagcctaaatcaggaaatagtctggcggaaggccgccgagctgcccgtgcaatggccagaaggcgggaccgctacaagagaaggcggaaagctgtcttgcgcacattaactgagtatggtctgatgccagcagatccgaaggcccgacaggctctagttgccaaaacgggggacagaggacccaagagcgaagaggcgctcgcagatgtgtactccctgagggcccgggctcttatggaaaagctgcctttgcaccatatcggccgtgccctcttccacctgaaccaacgcagaggctttaaatctaataggaagaccgaccggaaatcgaacgagaagggggcaattgagacaggagtaaatcgactgctcgaagagatgcgcgatactggtgctccaaccttaggcgcctatctggcgaaaagaaggtcagacgggcggcccgtgcgcgtcagagccggagcaagcgaacaggaggctgaggatggcaagcctgccaagacagcttacgacttctatccagtgaggcgtcttttggaagaggaatttgacgccatctgggagaaacagtacagttatcatcccgaagttctgaccgaggagcggcgaggtcacctattcagagtgatgtttcatcagaggcctctcaagccagcaatagtcgggcgctgctccttcaactctgccgaaactcggctggctaaagcgcacccgctttttcaagagttcagactgtacaaggaagtgaatgagttggaagtagttatgcccgatcagagccacaggaaactcacactgcctgagcgcgaccgattagtgctgaagctccggggacagcgtaaagcaacctacgccgctcttagaaaggagctgaggttgcgcgatctacggtttaacaaggaaacggagaatagaactgacatgatgggcgatgaagtcaccgccgcactggccgacaaagctgtgttcggcaacaggtggtccgggttctcaacagatgagaagtggcgaatcgtggaacgcctccgggaggaggaagacccatttgccctgcatgagtggcttgtcagtgaacacggactgagcgatgcagaggcggagcaggctgccaaagttcatttgcccgacggttatggcagactcgggcctactgcagtgtctaccatgctggaagagttaaaggccgatgtaattacagaagctgacgccgcaaggctggctggatacgaccactccctagcccgtgcggatgaggacggcctcgatcgcctgccaaaatatcaagaagtgcttgagcggagaatcccgcccggtaccaatgaccctgatgacccctacgatattgccaaggggaggatcacgaacccaactgtccacatagctttgaatcagttccgacatgtggttaacgcactggcccggcgctttggcaagcctgaccagattgctatcgagctcgccagagaactgaaacttaacgataggcagaaggacgaggtgaatcgggtcattggacgaaacacaagagcagcggccctgcgctcacaaaaattgagggatatcggccagaaggacaatgggtataaccgtgctctcctgaaattatgggaagaactgaatcccgataagccagaagaccgggtgtgtgtatacaccggaagacccatctgcattagcatgctattcagtggtgaggttgacgtggatcacatactcccttggtctaggactatggacgattcccaggccaaccgcatcctgtgtgtcgtggaggcaaatcgagtcaaggctaacagagccccagcagaagtggccgagtggggcgggcggtatgacgaaattcttgagagggctgcgcgcttgccgcgtaataaaagatggcggtttgccagggatgcaatggaaaagtacaaagagaacgagggattcctggctcgccaactcacagacacccagtacctgagccgattagccagagaatatgccgaggctctgtaccccacggaggagcctgatcggcttggcgagttgaggcgcagaaatcatgttagggtgatcccaggtcggctcaccgaaatgctgcgtcgcgggtggggcctaaacgcactgctccccgaccacaattttggagccggccaggcgaagaaccgaaaagatcatagacaccacgctatagacgccgcagtagtcggggtgacaactaggggactgcttcagcggatttcgaccgaggccggtttgcgcgaaaagctggctttagaggaaacaatcgcagatatccctatgccatggcccggcttcagagaggagctcaaggccgcgattgacagggctgttgtgtctcataaaccggatcacgggactctgcctaagccaggagaacatggccggaccgccggtcaacttcacaatgacacagcatatgggatcaccggcgagactgacgcccgaggaaaccccattgtcgtgagacgcaaaccttttctgtccttgacggataaggacataccctcaatcagggatacagaactccggggccgtgtatacagtgctaccagcgggctgtccggaagagagctatctgccgcactggactatttcaggaaaactgataagcagtttcgcggcattcggcacgtgcgagttaccgaaagcctctcagtcatcccaatcagagacagggatggtaacatttacaaagggtataagggagacgctaatttccgctacgatgtgtgggagctgcctgacggcaagtggaaagccgatgtggtcacaatgtttgacgcgcatcggcccgacagagccgcagaggaacgtaggccacacccggctgcccggaaggttcttagtttgaaacagaacgatatggtggcttgcgagcatcctaaggacggttacaccataggccgcgtggtaaaattcaatactgcagggcagatctatttcgccgcccacaacgaaggaggctccctgaaggctcgagatgcggacagagcagatccctttaagtacttcagcaaatctgcctcagggttaaaggagattgctgccaggcaagtccggatcgacgcaacaggacaggtgctcgatccaggcccccaggaccgcgaaagtagactggccaggaataaacgacttgagcgggagcgtgcttga

SEQ ID NO: 2749 - RNA, 3303 nt, synthetic construct
  misc_feature 1..3303: note = Cas9 variant
  source 1..3303: mol_type = other RNA
atgaagtacaccatcggcctggacattgggacaagctccgtgggatggggtgtcatagatactgagagaaacaggatccaggacctcggcgttcggcttttcgaatctgccgagaatcaaaaagatggggaatcactggctaagccccgccgagacgcacgtagtatgagaaggcggttggcccgcagaggaagcaggttagagcgggtgaaatccatttttgaaaaggcgaaattcctgacgcgcggccagatgggtatcacccacgctcgacctaacgatccatatagactaagggccgaggggctcgaccggctgctttctaatgaggatctgtttattgcagtataccatttggccaagcgtcgcggatataagtcgaacagaaagaatgtgctcgaaggcgacggcgaggatgtcagggaagggaaggctgtgctggacggagttgcacagaacaaaaagctgatggccttccggggttaccgaacagtgggcgagatgtttttcaaagattcagtctttactgaggctaagcgcaataaggccgggagctataaacactgcgtgctcagagaaatgttagaggacgaactgggaaagatccttcatgcgcagaggagtttgggcaacaccctggtaacagattccttcatatctaaactactcgagaagaaaaccggtgtttttgtgtaccaacggccgttcgcaagcgggaatcagatcctgaaacttgtcggaccctgtacttttgaacctgaggagattcgcgccgctaaagccacatattccttccagtactttaacgtgctgcagagattgaataacctcaccatcaagaatacggacactggcaccgaaaggaagctgacatcagaggaacgtgcaaaaatgattgctttcatcttcagtcacaaggacgtgcaatacgcccagatacggttagagctgaaactcagcgatgtcgaccgatttaacatggttaattatttcgtgcagagaaaggaacttgagactaaaaccgcggaggaactgaggcgcgagattgaaaagaagacaaaatttccatctttgtccgattactataccatccggaagacggtatcagagattgacagcgccttctggatccagatcgaaaaacaacatgatgtgattgacgcaataggcgagatctttactctatacaagacagatgaggacattatcgctcagctgaacaccagaatacccagtattcctaggccagtcgtgtctgccctcctggggctttccttcactaaatttggacacctgagcttgaaggctctccgcaagatcatcccccacctggaaaacggtgatacatatgacgttgcctgcgcaaaagccgatcctaagtacaccgaccgagctaaaacgcgggcgcgtaagttaagaccactggacaaagaggatcattcgattaccaatccggtggcaaggcgcgccatcgctcagacaattaaggtcgtgaacgccataatcgacaagtatgattctccctccgaagtacacattgagctaggccgggacctcgccaaaaatttcaaggagagaatgaaaatccaaaaggaacagaaacagaaccaggaggggaatgaaagggcaatcgctaagattcatgagctgtacaaacttgaaaaccctcgaggacaagatataatcaagtttcgcttgtggaatgagcagaacggccagtgtatgtactcaggtgagcggattgacgaaatcagactgttcgataatgggtatactgagattgaccacatcataccatttagtaggagcttcaacgattcctactctaataaggttctcgtgctgaaaatgcgtaaccaggaaaagatgaataaaaccccctatgagtacatgggcggagacgccgatacatggcaacgctttgaaaaccttgtcaatagcatgcacaacatcggccctcggaagaaacagaacctgttgctcaagaagtatgtggcagacgatctgactttaagaaccctgaatgacacaaggttcattgcgcgatacatgaaaaactatatcgagaataccctactcttcactgaggggccacagaagcagcgggtctacacggtgaacggacaagctacagcctacctgcgcaaaagatgggttcttcataaggacaggaccgaaaataaccggcaccatgcacaggatgccgtggtagtcgctgtggccactccctcattggttcagggtattatgcgacacgcaaaaatgggcgagatcgtggactatctgcatagtcagaagtttgctccgaatgtcaccgatatagaaacagggaagcctttcgagtccgccgacattcaaagcgcgaaagaaagaatcattgccaagcacgagcaccgcctcaggatccccgagccatgggaaggattttctgatgagctggacgctcgtatgggcgatgacgtggtagaaaaattatcactgcggaagagtaacatacatggttacaaaaccactagcgatttctcccagatccaccctatttttgtgtctagaatgcccaagaggaagacaacggggcgcgcacatcaggagacccttcgatcgccaagacggttcaaagagtttcaagaaagcgttgtcaggactcccttgtcctcaatcaatctcaagaaactggaggaaatgagtggcaagaactctgacaaactactgtatgatattctccgcaagcgtctgcttgcccacggagacgatcctaaaaaggctttcacagagccagtgcacaagccgagaaaagacggcacccaggggcccttggtgcggagcatcaagatggtctccgaaggacagaggtcaggtatactggttaataacgagcaggccttagtggaccaagatagcatgattcgcatcgacatcttttctaaacctaataagaaaggcaaggatgagtactatattatcccagtgtacgcatatcatttcgcgcagaaggaactccccaacaaagtaattacagccaaggctgaggccgactggcgaactatagatgacacctttgcattcgaattttccctgtaccctaatgatcttgtcaaactgacgaagggggacgatatcagattcggatactatagtggctgcaaccgggctttggccgcaattcacatcctcccacatgaccagaacatgcccctggtgaataacggtattaaaaccctagataagatcgacaagtacgttgtggacatactgggggagtatcacaaagtcggcaaggaaacaaggcagcaaatccagtga

SEQ ID NO: 2750 - RNA, 3303 nt, synthetic construct
  misc_feature 1..3303: note = Cas9 variant
  source 1..3303: mol_type = other RNA
atgggcgccaccatcgtgacagacattagcagatccgctttcgcatttgatatagggactaagtctatcggatcagccgtcctgaggctcgacgatcggggtgagcccattggcatcattaacgcggctgttcgcatctacgccgacgggcgagaacctaaaagtggaacgagccttgcagagggccgtagactggccaggggtatgtcccggcgcagagataggtataagcggcgccgaagaaccttgttaaatacactgactgagttcgggctaatgccaccgaccgacgaggctaggaaagcactcctggccgaaacaaacgatcggcgttttggagctgtggccggcaatgtatacgcgcttcgcgcaagagccctggacgagaagttgcccctccaccatctgggcagggctctgttccacctcaaccagcggcgagggtttaaatctaatcgcaagaccgataagagagacaacgatcaaggaaaaatagcctcgggtatctcaaggttaggccagaagctggacgaggcaggggctcggactcttggagagttcttgcatcgccagcacagcgccggcaaatgggtgagagtcaggcctagtcgtgtgccatccaaggatgacaaagaagaagacggttatgggttttaccccgagcggtctttcctggagcgagaatttgcggccatttggaaggcacaggctgccttctatcctgagctactcacagaagagagaggagatcatctgcacagggttatgtttttccaacgcccacttaagcggcccaaagtgggcaagtgcagcttttaccctgacgaagatagactgccaaaagctcacccgttgttccaggagttcaggctcgtcaaggagctgaatgaattagaggtggtacatcgcggcgaccgacgggaaaaactgaccctcgagcagcgtgatacgctttttaaccagctgagaactcaaaggtcctcagccttcaccgcattgcgcaagacactaaaagcccccactgggacccggtttaataaggaaagtgacgctagagataagctgaaaggagacgaggttgcggcagagatgagccacaaggataggttcggtcaggcctggatcggcatgcctctcgctgaacgatgggccgtgattgagatgctgcttgacacagaagatccactggaggtcaaagcatggttggaagaacattatgggtttgccgctgaccgcatcgacgccatagcagcggctaagctaccccctggatacggccggctgggtgagaccgccttaagagatatgctggacgaactcaaaaacgggacggtgaaggatgactctggcagggatgtggtcctcactgagcgtcaggcaatggacaatatttggaaggataacccagccctgcagcgcgttgtggctgacgcccgggaacttcccccgtaccaagaggtattgggaagaaggatccctcccggcacagggaaaccagaggatccttatgacgtgcagaagggacgactgaccaatcccactgtccacattggtctcaaccagctgaaacgggtggttaatgcacttgtgcgcagacacggcaggccagatcaaatcgctctggaattggcccgggagctcaagctgaacgaggaacagaaagcggaaaaggaccgagagatcgccagaaacacaaaggctgcacaggcccgctccgagaaattaaggcagctggatattgacgacaatgggtacaaccgtgtcctactcaagctgtgggaagatcttaatttgcggcaacccgagaacagagaatgtatatattgcggaaaagctatcggcattggtaccctgttctcaaatcaggtggacatcgatcatatactcccttggagcaagacgctggacgatagtcaggccaacaggattgtatgtcacgttgagtgcaatcgccagaaagggaaccatgcaccagcggaagtgccgcaatggcacgaccgatacgatgacatcttagccagagctgagcggctgcccaggaataaggcctggcgctttggccgtgaggcaatgaagaaattcaaggatgacgaatcttttcttgctagacagttgaccgatacacagtatctctcccggatggcccatgagtacgtcgcagccctgtatcctgacgaggaaccagatgaatggggagtgttcactaggcgcaaccacgtccgagtgatccccggcagaatgaccgagatgctacggaggcagtgggggctgaatgctattatcagcgaccacgaccagaaaaaccgcaatgatcatagacaccatgcgattgacgccatagttgtgggagtaacaactaggcggctcctgcaacgtatcgcaaccgctgccggtggccgcgaggcccttgctttggaagagacaattgggaagatcgaacctccatggcccggattttacgatgacgtcaaagaggcaatcgatcgaattgtggtttcgcacaagccggaccacggctctctgcctaaaccaggtgagcccgccagaaccgcggggcagttacataacgatactgcttacggcttcacgggagaagagaggaagggcgtgcctataatggtccaccgggtgccctttgccacactcaccgaaaaggacatcccatccattcgcgatagacagctggcagaggccctttatggggctatcgcaggaatttcaggcaaagccgaactggcggctgccttggcaaggttcagtgccagcggtccttacaaggggatccggcatgtacgagtggttgagcccgtctccgtgatagctatcaaagacagagatggaactccatataagggctacaaaggtgacgccaattatcgctacgacgtgtgggagctcccgaacggcaagtggacccacgaagtcgtttctatgttcgatgcacataggcctgactggcaaagcgagattcggaacaagaatcccgctgcccgtaaagtgctgtcactacaccagaacgatatggtggcgtatgaacacccacaggacgggtacacaatcggaagagtagtcaagtttggcagtgggggacaaatggccctggcaggcaatagggagggtggggctctcaaatcccgcgatgccgaccccgaagatcggttccgatacttttataagagcggaggcgctatgagagacgcaaggctgcgccaggtgcgggttgatgagaccggtagagtgttcgaccctggcccacaggatcgtgagtctaggaacgcccggaaacagtcagccgctgggtga

SEQ ID NO: 2751 - RNA, 3306 nt, synthetic construct
  misc_feature 1..3306: note = Cas9 variant
  source 1..3306: mol_type = other RNA
atgaagaccctgggcctcgaccttgggacaaacagcctgggatgggccatcgtggagactagagatgaacccacgaaatactccgagggttctattgtcgcttcaggcgttaggatattcagtcagagcgaaatggcagggcgggaccctcaatccaaggcctctttggcggtggctcgccgacaggcccgtggatcgagaaggcggcgcgatagatatttaaaaaggcggcagcgcctggtagacctactcgtggatctgggccttatgccagcagacaaggccgctcgagcagagctggtcaaaaatcacggtgatgggaagaccggagacttgtcaagcagtgtgtacgccctcagagctagggccctggatgaagcgctgtccccgtatgagatcggccgggcaatttttcatctcaaccagcgtcgcggcttcaagtctaatagaaaagccgacagcaacgatcccgagcaaggggttatctccgaaggaatgagggctttagacgagaagatggccgaagctggtgcacggacaattggcgagtggctgcacatgcgacgccttcaggggttgcctgtgagagccaggatcgcgccagatggagagggctacgccttttatccctcacggggtgcactggaacgcgagttcgacagaataatggctaggcagactctatttcataccgacctcctgacagataccgccatccgtgaacttcgggaggtcgtgttccaccagcgacctctgagaccagtaaaacccgggaagtgcagttacaatcctttggaagagaggctcgctaaagcccatccactgtttcaaaagttccgcttactgaaggagctcaacgaacttgagattgttggagaagaccagaaacacatcaagctgactccggagcagcggaatgcattggccctacagctgagaacaagcctcaccaaacaaggcaaggtgcccttttctaaactgaggtccacgcttaagctgggccgcgaagtccgattcaacaaagagactgataatcggtcagacttggagggggatgtgatttattttcgtatgagcagacctgaatgtttcggaaacaggtgggctgacctcccagtggagatgcaggcggcaatcaccgaacgcctgcggacagagcccgattacaagactttaatgaattggctgaaggccgaaaccggtctagacgaggtccacgctagagccgttgcagatacacctgtgccagacggctttgggaggctcggacagagtgccctgaccgctcttatagatgccttggagaacgaagtaggcgagggtgggttcgtgattacggaagcagaggcggctaaacgagtctacggccgcactaattctgaggccgaccccgaccggaagggagtggatgaactgccgaaatatcaagaggttctcgcaagacatatccctcccggcacaggggaaccagacgatccttacgacgatttcatgggaaggattaccaaccccactgtgcacatcgccctgaatcagcttcgtcgcgtcgtgaacgctctgatccggacatatggtaagccagacagaattgccatagaggtaggcagggatttgaaaatgaacgaccgagaacgggatgaggttaatcgcagaatcgggaggaacaccaaggcagctattgagcggggagtgaagctcacggaaacctttcgacagctggacacaggctacaatagattacgcctggagctatgggaagatctcaaccagaaacccgagaatagggtctgcatctattgtggtaaggccatagcggggcatatgctgttcaacggcgaaactgacattgatcacatccttccttactccaaaaccttggacgacagcaaggccaatcgtatcctgtgctgtacatcgtgcaaccgggagaaaaagaatagaccaccgtctagggtgccccaatggcgctcccgatatggagagattctcgctagagcaactaccctgcctaagaacaaacagtggcggtttgccgaagatgctatgacaaggttcggcgaggaagaggggtttttagcccgccagctgaccgacatgcagtacatctcacgtcttgcattgacttacctcgcgcacctgtatgattacgaagaggtcgacctagatggaatttataagagacatgcccgggtgagggctctgccaggtcgcatgacggagatgctccgaagacaatggggcctgaatgaacttttgcacgaccataacctgatagggggagatgttgccaaacccaagaatcggttagaccacaggcatcacgcaatcgatgctattgtgatcgcctgtacaagtcgcgcactcatccagagactggccaccgctagcgcggccgcagaggaaaggggcgctgagcgggtagtcgagcgtattgaccctccatggtccggtttccgcgaagatgtgcgagccgccgttggggctatagtggtctctcacaaacccgaccatggcactgtgggaagagagggctacgcaaaggggaggggacagaccgccggcaaacttcacaacgatacagcgtatggtcataccggggaaaaggacgctagcggaaatgacatcgtagtgcggcgcattgccgttactgatatcagatcaccggcagacattaggaagatccggacaaacgcccacggccacagtgagctgcgagatagattgtacgaagctacgcgcggtctcgagggcaaagcatttgagcaggccgtcctggacttcgtgaagggggatgcgaaatttaggggaatacggcatgtgcgtatcaccgaagtcgctaaccctgtttggattactcacggcgacgggagacataagaaaggatatctaccaggcggtaatgataggttcgacgtgtgggagctggccgatgggcgctgggacgcagaagtggtaacaacctttgatgcccaccggcccggattcgtccctcgaatgagactcgagaaccataatgctaggaagatcatgtccctgaagaaaggcgacatgattgcctacaacgaccccgtgagcggtcaacgcatcatagcaattgttcggaagtttgatcagagaaataaacagctttacttggacccacacaacgaagctggcaatctggatcgtagggagaaggagaaaacatataagcctttacggcccatgccaaacccgctcaagaaataccgccctcgacaggtgagaatcgacgaaattgggcaagtcttcgatcccggaccatggtgggagaggcaggacggctga

SEQ ID NO: 2752 - RNA, 3306 nt, synthetic construct
  misc_feature 1..3306: note = Cas9 variant
  source 1..3306: mol_type = other RNA
atggagcagaccagcctggacctctcccaagccatgaagaaagtggctcagccccagaagccttacagacttggcgtcgatgttggggtggcatctatcggagccgcggctgtaacagacactgaaattctgggtatacacgtgaggacgttcgagaaaggcgaaatcaacgggaagtcaggacggaaaccattgaatgccgattatcgccgacagaagggccaacgtaagagattaaggcggaaaaagaaccgcctgctaagtctcagaaggctgtttcggcgcgtcggtatgattgagagcgcagccatcgaggctttcccgatttcctctacctcgccctggcagcttcgaacagaggggctggacagaaggttgactaatgaggaatgggcacaggtgctctaccatatcgccaaacaccggggatttcagtcaaaccgtcgcgttgatatggacgaggctaccaagctgagcgatgccgcgggcgacagtcctgaaacaaccactaatacagagtccgattctgacaccaaaaagatgctggcaggcgtggccgataacaagagactcttagctgagaaagggtataggacgataggagaagccgtcgcacgggacccaaagttcagccatcgaatccgcaataaagaggaatcctactcacacactattggtagagatgagatcaacgctgaactgaattgcctttttcaagcccagaaccattatggcaatccccacgcgaccgaggagttgagtgaacagattatcgacctgataaactggaggcggaagacagtgactggggacgatattaaacgcatggtaggaagatgtaccctagagcctaaggaatacagggccgcaatccacagcgtttctgctgaggagttccgttggctctccacactgtcacggcttcgaattgtgacccagggcgaaagcagaccactgacgaaatgcgagtgggacaaggtcgtggatttgccctggaggcaagaagccatcacttatacaagtatccgcaatgctattggtctccggcatgacataagatctaggtttaacatccgctacgagaccgggggaaagaaaactaagacagataccaaaaatgaaacgaccaagggccagtccgccgacgcagtgacaagcgaggtcaaaactgccgaaaaggagaccgctttcaaggcgaaaggctaccacattctgcgaaaggcatataaagcctttgggtacgatgagcagtgggaccgggatcgtttcaacacagaattactggacactctcgctaccgccgttacattttataaggatgactcggagatccaagcacatcttgaaaccaacgacactcctgagtacgccatacagattgctctgagattgccaacgctaacaaaattctctaagctgtccaataaggccatcctcaaaatcctgccgcacatgagggagcgccagtcatatagtaacgcatgtcttctggcgggatacaagaatcaccataaacagtatgatgacactccccaaaacggtaagattcctcggagcgctatcgaacacattaaaaataccgtggtatacagatccttgaaccaggccaggcgagtgataaatgcaatggtcaaggagtacggcgccccacaggaagtgcatatcgagctcgctcgcgatatggaaaagtctgccaaaaagaaagacgagattgatctgtggatgaagaaacggaagaaaaagaacgacgagttaagagaaaggtttgggaagaatctgagccgtgatgagctactcaaatataagctgtacgaagaacagaacggacaatgcgcatattcacttcagcccatccagttgggccgcctgctcgaacctaattacgttgaggtggaccacgctctgccacggagtagatccatggataacagctataataacaaagtccttgtgctgaccaagcagaatagggacaaaggtgatcgaacacccttcgagtacttcggggaagaccaagagtctgtagattggaagcggtttaccaactgggttgaatcaaacccgcagatgcctcaggccaagcgcagaaaattgctcactaagagtctgcagaaaggcatcttagacaatttcagcgcgaggaacctgtccgacacacggtatattgcccgagagctaaagacgctcatagaacattacatcctgaatacccccgagagagagaaaactaagtacgaacgctgtgtggtcatttctggaaaacttacagctcaaatgaggcagttgtggggcatctcgaaggcacgtgatgtgagcgaccggcaccacgggtccgatgccgctgtcattgcctgcatcaccccatcaatggtgagaaggataacacgctatctgcagctccaagagaggagagcaatgcctagtgcgcccggaaagggtgacgaacatccagccgttgtggctcgggccatcccccacgcacctgtaccatggccgacttttgagcatgatctggaggctgccttagaaaaagtcctggtgtctaggccccagagccgcaagtggtccggccctattcacgcagacaccatctacggggagcacaaagatcaggaaacgaacaccgttgccccaacacagcgtattaaacttactcaattgaccaagtcaaattataagaacatcgtgggatacgacgaggaaagaaataaggatttcatagaccagattgaggagcggctcgaatgtcataactttaatggcaaacaggctttcggtacaagccagtctcccatctataggattaagaaaaacggggagctgggccctgaagtcaagaaagtgactatcaagctaccaataaagaactccgtatttcgcatccgaagaggatacgtgaaaaatgcgaagaatagtaccatttatatcaacatttaccaaaatacgaaaacaggcaagttcgagatgcaccccgtttacgccaaagatctgaccagctctgcaaacgcttccaagtcatttgaatatagtccggacctccagctggtcgatactatccggcgaggggactacatagagattacacgcagaaacggagaggtgatcagcggttattacgccacccataatatctcgacttccgtgcttgaattgcagcctcacgacaccacagattctaggaacaatcggacgccagccattaagaccagcctgaacatcgagcgtttccatattgacatattaggccgcaaacgaagagtcgttaggcgggctaagaatgggctcgcagatgaccgcgataaatga

SEQ ID NO: 2753 - RNA, 3309 nt, synthetic construct
  misc_feature 1..3309: note = Cas9 variant
  source 1..3309: mol_type = other RNA
atgggctacagaatcgggctggacattggaataaccagcgtgggttatgccatcctcaagacagatgagaaaggctccccctacaagattgaacaccttacttctgtcatcttccctattgctgagaacccaaaagacgggaagtcactggcaatgccgaggcgggaacagcgcggagcccgacgtagaaataggcggacgaaatttcgcaagcatagaaccaagatgttgttcgttaggagtgagttactgacaatcaaacaaatagaagcgatctatagcgagaagcagaaactatcctctatttacgagctccggactaaggctctgaacgaacgccttaccaatgaggaactgtttcgaatcttgtatttcttttcgggccacagaggtttcaaatcaaacaggaaaagcgagctcacagagaaggatatggggcccgtgctgaccgccattaaagacatcgaagagaagctggcagatggaacttaccggacactcggcgaatatatggagttagacgaaaaataccaggagcataagcgtaataaagatggcatagaccgctacctggggaccgccaagagaagtcttattgaggatgaaatcaaacagattatcatcgctcaacagcagtttggaaacacgaagttgacttccggtttccaggtagcatttattggcgacgaggaacaaaccgggatattcaatgatcagagggagtttgaagacggacctggcaagcagtctccatatgccggtaaccagatcgagaaaatgattggggcttgcacattcgaggaaaatgagaagcgggcccccaaagcgagctacacttttcaatatttcgatttcctgtgtaagctaaacaatctcaaataccgagaaaccatcggaggcgagtatcgctttctgtcccttgaacagaagaacgtgctgaaggagaaagtcttgacaacccagaagataacgttctcaggcgtgaaaaagctcctggacttacctgagcacgcacaatttaatctggttaactacgggactaaaagtacagtgaaggaaaccgagactaagagcgtcttctatgccatgatttcttaccataaactcaagaaagctatcccagcccccatcttttccaatctttcaacagcagaactggacgagattggaagaatcttgaccctatacagcagtgataagggtaggaaaaacgagttctattctcggctggctattcctgaagaggtggtagaagccctcctgccaataaacttttccaagttcggcaatcttagcctgaaggcgatgcgcaaaatcattccgtacttggagatggggctcgtttattcggaagccgcaacgcaggctggatacgactttagacacaagaaaatcgatcaggcctatatccacgagaacgtgaccaatcccgtcgtgaagagggctgcctctcagacaattaaaatagtgaacaatatcattcgtaagtacggcgagcctgacggtatcaacattgaactggcacgggagttatccaaaaatttctcagaacgaaagaagactgtcaaatatcaagaggaaaacagagccaggaatgagcgcatcgctgataagctgcgggagtgcgaactaccagttaacggggcgaatataaccagactcaaactgtttgaggaacagggcgagttcgacccctacacaggacttaagatcccttttgatagggcattcagtgaagagtacgaggtggaccatattatcccatatagcaaaactttggatgactcctacggcaacaagattctggtatctgccaaggctaatcaggaaaaagggaaccgcatccccatggagtatctccagggaaagccggaacgaataaagaagctggagagcattaccgccacaatcaaaaatcctaagaagcgggagaaacttctgaagcaacagttgaccaaagaagatgtggacggttggaagactcgtaacctcaacgacacgagatacatttcaagtctgttacacgattatttcaatcagaacatctcctttgcaaaactggagagcgaaaagaagaaaagggtcatagccgtgaatggcgctatcacatctaagctacgcgcccggtgggggttcaacaaaattagagagaatggagacgaacatcacgcactcgatgcgctgatcgttgcttgtgtgaccgacaagtacattaaagagatcacttcatttagtaagaggaaagaggtccgattcaacgaaaatctttggaagcgcgagaagacaccccaggaaatagagcaagaagtggtacactttaaaaaggattatgaccggattttcaaccaggcctttccattgccttggaccaatttcagagaggaggttagctgcaggatgtccgaaaaccccgcagagctgatgaaaaatcatacctgggaaacttacacagatgacgagatcgccgctctccgtccaatctttattgtgcgcatgcccaacatgaagacgtctggccctgcccaccaggaaaccatccggtcgggtaaactggaggagaaggggttaaatattagcagagtctccatagaaaagctgaaacttgataaggagggcactatcaaatcaggaaacgcacagttctacaaggacagtggcaatgggtggcaattgctccatgataaactgaaggtggctctagaaaagcacgacggagatggttctaaagcctttccagacggcgtcttcaagtatcagtacctggacaaagagcatacagtgaggaaggttcgactcgtggcgaaaagcaccctgcagacatcccttaacgagaagaagtcagtagccgataacgggagcatgattcggatcgacgtctttcgcaatgaacaaggaaaatatcagttcgtgccgatttacgctaaggatagagttgccaaaaagttgcccaaccaggcagtggctgtcggcaaaatcgccaaggagtggcctctgatagaagagtctgacttcaagttttccttatatagtaatgatctcatcagggtgaaacacaagaaaggtgtaaagcacgtgagcaaagacgggaacaaggaagagaaatctaagactgatttctttggctactataccggagcagacattgcgacggcctccatctcaggcattagtccaaataacttctttgagttccggagcatggggctggctacccttatctcgatagaaaagtacaaagttgattactttggaaattatcatcaggtcaacgagaaggtgcgacaaaaattccccaagaatagaatgtga

SEQ ID NO: 2754 - RNA, 3312 nt, synthetic construct
  misc_feature 1..3312: note = Cas9 variant
  source 1..3312: mol_type = other RNA
atgaagtacgacatcggcattgatataggggtggccagcgtcggagaggctgttatcgaccaggaaggtaacattctggaggcatgctccaatctcttcgatgaagccgacgcggcttctaacgtggatagaaggaattttcgggagggccgccgaaacaaacgtagagaaaggacccgggtaaatgacttcaagaaactttggacaaagtttgggttcgagatccccaaaaacgtgatgaatgatactattctgttgcgcaacaagggaatcaagtgtgagttagacctgacggaactatattcagtcctcctgtacatgcttaaacacagaggcataagttatctggaggatgccatcgacgaagcaaagggtagcaattacgccaaagggattgctttgaaccaaaaggagctcaaagagaagctgccttgcgaaatccagctggagaggctcaagatttatggatcctaccggggcgattgtatcgtgaaaaaggaagacgaggatgaatatcattctaatgtttttaccatatcggcatacaaaaaggagttagagattctgttccgcaaccagaaacttccagaagagtttatccagggctacatgaagattttcgaacgaaaaagagagtattacatcgggccgggaaatgaaaagtcaaggacagactatggtgtgtacactaccaacaaggacgaggagggccactatatcacagataaaaatatttttgaaaagttgatagggaaatgcagcgtctacaaggacgagttccgggccgctggagccagttataccgcgcaagaatttaacgtgctgaacgatctaaataacctcactgtaaataaccgtaaactgacagagaatgaaaagaagaaaatcgttgagaagattaaatcctctaacgcagtgaatatgcgcagcatcataaagaaagtccttggcgaggacattgaacagttcggtggggccagaaaggataaggctgacaaagagatctaccatacctttgaagtgtacaggaagatgaaaaaggagttcgagaaaaacggaatcgatattgccgacttctcccgggaaaagctggatgagatcggcaatattttgacgctcaacactgaaaccgagggcataaagggggcactgcacgaagctaaaaattcatttacatatagtgagatcgagactttaattgacatccgaaagaaaaacagctctctgttctccaagtggcagtcactcagccttaaaatcatgaatgaactgattccccagatgtacgcccaacctaaggagcagatgcagttgctaaccgaaatgggagtgtttaaattcaagagtgtcaagtttaaaaactctaagtatataccagttgaggaaatcattaaagatatctacaatcccgtggtagtgcgctccgtcagaacaaccattaagatgatcaacgagacgataaggaaatatggttaccctgacaacatcattatcgagatgccacgggacaagaatagcactgaagagaaggaacgcattaaaaaggagcagtcgaaaaacgaaaaggagtatgagggcatcctgaaaagaataaaggatgaatacgacattgagatcaatagggatgactaccgtaagcaagaaaaactcgcgctgaaacttaaactgtggaacgagcaggaggggcggtgtccctattctggaaagatgatttccatctacggcttgctcgaagatcctcagctgttcgagatagaccatatcattccaaaatcaatcagttttgatgacagccgaaataacaaggtgttagtttatagatccgaaaatcaaaagaaaggtaacaatacaccgtacatgtatctgtctaagggggataaaaactggaattacgaccagtataagagctacgtgctaggcctcaaaaacaagggaaatatttcagataaaaaggtcaacaatatgctgttcatggaggacatcaacaagatagatgtgcttaaaggctttattaccaggaacttgaatgacactcgctacgccagtcgggtagttctgaacatgctccagtccttctttaatgaaaaggacgggtgccccacaaaagtgaaggtcatcagagggagcttcacccaccagatgagggtgaacctgcgcatcaataaagatcgagacgagtcttattcacaccatgcagtcgatgctatgcttattgtgtacagtcaacggggttatgaggcctaccgtaagatccaggaggcttgtgttgactttgaaacgggcgaaattatagatgaggaaagatggcagcagtgcatctgggggaaggactatgatcaagtgatgtacgaggccaaatggagcaagattagggagaaaatcattgaagcagagaagaacgtaaaatatcaccatcgcgtcgacaagaaggtgaatcggggactgtgtaaccagaccatctacggcacaagaataaaagatggtaagatctacaaaatttcctcttataatatctacgacaacaaggaatgcgcctcgttgctcaaaatgattaagggaggcaaggagagcaaaatcctgatgtataattacgattccaagacttatagggacatgataaaaattatcgatgaatactcagacgagaagaaccctttcgttgcttatatgaaagagaccggagactacttccgaaagtacgcgaagaaacacaatggcccaaagatcgaaaaagtgaagtattacaaagaggaagcagggagttgtattgatatatctcacaagtatggatacgagaaaggtagcaagaaggtcatcttaggctccctgaacccctatcgcacagacgtgtttttcaatgagcggctaaagaagtactatctcattgggatcaaatacaaccatattaagtgcgaaggaaacaattacgtaatcgatgaggacgcctataacggcctgcttagagatgctggtgtgatatcacacgaaaatactatcaacgacttggagaaagttggggtcaagtacctgtttagcctctataagaatgatattatcaaatacgaaaagaacggcgagatgttcgtggagaggtttctgtctcgtaccatggaatatgccaataactacattgagacaaaacctatccataagccattctttcagaaaaaggacaagaaaggaaatataaagaactcccagaatttagtgggcctgagtaaaaccaagtatattgggaaacttgtcactgatgcattgggaaacacgtacatggttgaaaaggagaagttcagcctcatcgtggacatctga

SEQ ID NO: 2755 - RNA, 3315 nt, synthetic construct
  misc_feature 1..3315: note = Cas9 variant
  source 1..3315: mol_type = other RNA
atgaagctgatcctcgcccttgacattggcatagctagcgtggggtgggcagtcctggataaaaagtccgagaccgttttggaagccggatctaacatcttccccgaggcgtcagctgccggtaatcaggtgagaagggaaatgcggcaagcacgccgaattaaacgtagacagaggacacggttagacgattttaacaagctgtggcgcaaaaataacctaagtatccctcagtacaagagcactgagattgtaaatctcaaggtgaaagccctgagagaagagatctcccttgacgagctgtatttgatactctactcttatctgaagcacaggggcatctcgtacctggaagatgctcaggacgattcactcagcagttccaacgcatatacgaatgggttacgggagaacgccaaagctctggaaaagcattacccatgcgagattcaacgcgaccgacttcagaccatcggaaaatatagaggccagacacagattactgatgacaataacgagaagatcgatttgtctaatgtcttcaccataggtgcctacaggaaggaaattaaaaaggtgctggagacacaaaaactataccacaacgaactcaccgacgagctgtgtgatgactatatccttatttttaatcggaagcgtaaatactatgaagggccgggaaacgaaaagagccgcactgactacggcagattcacaaccaggctggatcagaatggcaactatatcgacgaggaaaacatctttgagaaattgattgggaagtgctccgtttaccccgatgaactccggggagcggcagcctcatatacggctcaggagttcaatctgttaaacgacctgaataacctcactataaatggtcgaaaacttgaagagagtgagaagcatgccatcgtgcagcgcattaagaccagcaacacagtcaatatgagaaaaatcatagcagattgtatgggcgaaactattgagaacttttctggggctaggatcgacaagtccggaaaagaacaattccacaagtttgagacctacaataagatgcggaaatcactgagcgaaatcggcacagatattgacgagttcagtcgcgatgagttggacaagatcggttacattatgaccataaacacggataaagaagccctaatggaggcgtttaatgaatctgggctgaacctcgacgactccgtgaaggagtgcctgatcagcttcagaaaagccaattcgtcttccttttcaaagtggcagagtttcagccttaagattatgaacgagctgatccctgaaatgtatatccagccaaaagagcaaatgactttgctcacagaaatgggagtagcaaagggctcctctggcgatttcgctgggctgaattacattcccgttgacgtgataagcgatgagatctataaccctgtcgtgaggcgttcagtgcggattagttttaaaatcttaaacgccgtcctgaagaaatacaaggttctagacaccattgtgatcgaaatgccacgagatagaaattccgacgaggagaggaagcgcataactgatagccagaaactcaacgaaaaggagatggagttcatcgagggaaaactggctcagatttataatatcaaactttcttcaagtgactttagctcccagaagcaattgtctctgaagctcaaactgtggaacgaacaggatggtatttgtctttactcgggccggacaatcgaccccgaggatataattaagaatcctgacctgttcgagatcgatcatattatcccaagaagcatatcctttgacgactcaaggagtaacaaggtattggtgtatcgctctgaaaatcagaaaaaggggaaccagaccccgtacttctacatcacgcacagcgatggagcctggacctatgagcaatttaaagcaaatgtcatgaacctctccaagaaaaaggaatacgccatttcacgaaagaaagtgcagaatctgttatatagcgaggacatcacaaagcgggatgttctgaaaggcttcattaaccgtaatatcaacgacactggttacgcttctagagtggtcctaaataccgtgcagaactttttcaaggcgaaagaagcagatacaaaggtaaaggttataaaagggtcctatactcaccagatgaggagtaacatgaagctcgacaaaaatcgcgatgagagctactctcatcacgccgtggacgctatgctgatgggcttttccgagatgggatatgaagcctaccggagacttcaaggcgagttcattgattttgaaaccggggagatcttgaagaacgacatgtggaatgagaaaatgtcagatgacgtctacgtggattatctgtacggaaggaagtggagtgcaatccgaaacgaaattgtcaaggccgagaaagacgtgaagttctggcatttcatcgttcgcaaaagcaatcagggtctctgcaaccagacaattcggggcaccagagaatatgacgggaagaaatacaagataaataaatttgatatcaggactaaggagggagtgaagctgttcaaaaagttagctttttcggaaaaagagtccgaccgtgagaagctgcttgtatatttgaacgatcgccagacgttcaataacctcgtcaaaatttttgaagactacaaggatgcccccaatcctttcgtgcaatatgagaaggaaacaggcgacgttgtgcggaaatactctaagagacacaacggtccaaggatcgataaactgaagtacaaagacggggaggtcggcgcatgtattgatatcagccacaagtatggactagaaaaggactcacgaaaagtgatactggagagtctcgtaccctaccggatggatgtgtattacaaggagtccgacaaaatgtattacctggttggcgtcaagcagtctgacatcaaaagccagaatggggcgaacgtgattgatgaagacctttatacccgcatcttgattaatgagaagatgatcgaacctggacaatccagagatgacctggagcagttaggttacgaatttaggttctcattttacaagaacgatataattgagtatgagaaagaaggcaaggtgttcgtcgagcggtttgttagccgaactatgccaaaagtgagaaactacatcgaaaccaagcccatcaataaagctaacttcgagaagcagaatccggtggggctcggaaagacaaaaagtattaagaaatatcgcaccgacatactgggcaacaggtacctttgcgagaaggaaaaatttactaagttctgttga

SEQ ID NO: 2756 - RNA, 3315 nt, synthetic construct
  misc_feature 1..3315: note = Cas9 variant
  source 1..3315: mol_type = other RNA
atgaaccactacgtgctgggcctcgacatcgggattaccagcgtcggatatggtgttatagatcttgacaattaccagttcgtggattatggcgtaagactgtttaaggaggggacagccgaagacaacgtgaataggcggactaaacgcggatcccgacgtttgaagagaaggcggcaaacgcgcttagatgacatgaaagagctgctacagaaggagaaaatcatgtctgaaacctaccattcaagttatgatccctacgacatgagaattaagggcctcagccagaagctgtccaacgatgaacttacatgcgctatcctgcacattactaaatgtaggggtaccacattggaggcactcgactctgccgatgaggactcggaagggaccaagtcaatcctgagcaaaaatgatcaggacctgaagaaatatcattacgtctgcctcgtgcaaaaggagcggttaaagcagagtggaaaaatacgcggcactgaaaacaatttcaagacagacgattacatcaaagagctggacgagattctttcccaccaggatttgtctgaagacctgtgtgagaagatccgaaccattgttagcagaaggcggcagtattacgaaggccctgggtccgagaaatcaccaacgccgtatggacgttggatcgcgcaaggtgtggctcccatagatctaattgaaaagatgcgcggcaaatgcagtgtctttcctgaccagctcagagccgcaaagaacagctacactgccgagctgttcaatcttctgaacgatttgaataacctcgagtgtgaaggggagaagctgaccacatctcagaaacaggacgtgatcgattttgtaaatgaaaagggaggcattactccaaaacaattagctaagctgctcaacgttgaccttaatcagatcaaaggtttcaggatcgataagaacgacaagcccctgttgaccgagtttaaagggtataaggcattcaaaaagatttttgacacaaacaattgcgatctatacaaaaaggacctgtccatactcgatggactggccgaaatcgtgaccggcaagaaaggcattgaggagcggaagcaggctatccaacaggcctatcctgaaatagacgaggcgattgtcgaacagtgtgcagtgatgaaagggatgacgcagtaccattcacttagcctgaaggccatgcacttgatcaaccaagagatgctccagagtccacgaaatcagatgcaagtgctgcacgaatctcatgtcttcgataaaaaccgcgtttcccacaagggacagaagtacatcgaggctgacgatgaggccattttaagccccgtggtaaaaagagcacagagggaaacttttaaggtggtcaatgctctgcgggagaaatatggtgagttcgaatcgatcgtggttgagacaacccgcgacagaaactctcaggaacagaagaaaaggctaaatgattcccaaaagtactatgagcaggaaaaccgtaaagtggacgagctcctgtcacatgaaggctacgatcctagtaagattaatgggaagactaaacttaaggtccggttgtatctgcagcaggagggaaaaacagcctacaccaacgcgccaatagacctcaatctgcttatcaaggatgccacggcatatgaggtggaccacattatcccgctgagcatctccttggacgattctattaacaataaagctctcataaaccgaaccgaaaatcaaaacaagagcaacatgacacccatctacgccattctgagaggcaagttaaatatctcactggacacttacaaaaccgtagttaagaacaataggaactatacaggtaaaaagcgcagttacctactctatgataaagacattactaagttttccaatatgcaggagttcatcgctcggaacctggtggataccagctacgcctgcagagtcgtgatgtctacactttcagactatttcaaggataatgaaataagtacccacgtccatactgtgagggggcgcgttacgaacatgtttcgaaatcggatcaacatgcagaaagagcgtgaaaaggactacttgcaccatgcagtggatgccctgattgtagctagcatcaaaaagctcaatctgttaaacacatatctgcttaaatacaatttcaacgacttgtacaatgaggagaccggcgaagtctttgcggtgggagatgaccaacaggttctcgatcctaagtatattagattcatcactcagctgaagaccatatacgacgagtccaacatgtattacaacggcctaattgaaaggaatgtgatgcagtttccacccatcaaaatttctcacaagatcgacacaaaacctaaccgccaaatatcggatgagaccatctatagcactcggacagtcgggaatgaagagtacgtggtaaagaaatattccgacatttacgatccaaagttcacgcagctgaccgacgatatcattaacgacagacccctcgataggtggctgatgtaccgaaatgacaaccagacttttaaaatcatacagtcaattatccttgatcatttccacatctttaaggacgatgagaagcactatagttgtaccaaaaagaaaggacaaattcagtacgcattgaagggtaaaaatccgctgtatttatacaagcaggaacatggcaaggtgcgcaaatatgccaagaaagggaacggacctgagatcacaatgatgaagtacttcgacggcaaactcggtaataacattgacatatctaatcactatcatgttcacaacaagaaggtcgtgctgcttcagatcagcccctaccggacagatttttacgtgtccccagaagggaaatataagatgctgactgtcagatacgctaatgttttctataaagagtcaaagaaaaagtacgtgattgacgagaagtggtatgccagcgagaaaaagaggaaaaacatcaccgatgacgatatttttgtgtgctctttgcaccatgacgaactcatcggcatacaaaagaaagatggagcaaagtacgtatatgacctgtccacggaagatggcgggaagcctcgtctataccacggagagatggaaatcctgaaattcaccgccacaaataacgacagtaagaacattatcgaggtcaaacccatttacacttattgtaagaaacagctcatgatcagcataggtccaattaccaagctggctaaatacgccacagatgtgcttggcaatgtttatgaggtgaagaagaacatcatcgaccatttgtctcacctgtga

SEQ ID NO: 2757 - RNA, 3318 nt, synthetic construct
  misc_feature 1..3318: note = Cas9 variant
  source 1..3318: mol_type = other RNA
atgggcatcagaattgggctggacataggaatcgccagcgtgggttgggctgtcgttgatgacgattacaacattatcgagtccggcgcaaatattttcaacgaagccaaggcggcttctaatgtggacaggcggacctttcgccagacaaaacgactccttcgtagacaaaagactaggctgcgggatttcgacatcttgtggataaacgccgggttagatatccccaaagagaaggtaaataaacagctgcagtttcgcgtgcagggaatgacgatggaactatcagagaacgaactctatgcagccctgaagaatatgcttaagcacagaggcattagttacctggaggacgctttggatgaggaacaaagcggtaaatccacctatgagaaggggctccaggtcaaccagaaagcactgaagtgcgacaaaatgccttgtgaaatccagtacgagaggctgatgaagtatggatcttaccggggccatattgaggtgaaggatgaatcgggcgaggaaatgatcctctcaaatatattcacattagacgcctattgcaaagaggctaagaaaattctggaatgtcaaaagcagtaccacagctttatcactgaggccttcgaggatgactaccttgcgttgctgcgccgaaaaagaaagtattacgaagggccaggaaacgagcagagtaggaccgactatggtaaatacacaaccaagctaaatccggaaactggcgagtatgttacagaagagaacatttttgagaagctcatcgggaaatgctccgtgtaccccaaggaaatgcgggcatctgccgctagctataccgcccagatctacaatatgctgaacgatcttaataacctgacgattaacggacgtaaattggagtacgaagagaagaaatccatagtcgaagaggtgcaaaaggcatcaagtgtaaatatgctcaagatcattaaaaaggttatcaacgaggacataactaccattgaaggcgctcgcaaagataagaatgacaaagagatcttccataagatggaaacatataacaagatgagacactactttgagaaaaatggtctggagttcaagaaaatcagcactgatgacttagatgaaattgggaacatcctgaccctcaatacagagaaggaagccattcttgaggcgtttaacaaatctcagctggaattgtcccaggaggagaaggaagccttcatagagatcaggaagaaaaatggatcactatttaacaagtggcatagcttcagtctgaaaattatgaaggaactcatccctgagctgtatcttcaatctaaaaatcagatgcagctgttgaccgacatgggcgtgttcaagaaaaagacggaaatctttcagaactacgataagattccaactgacgtcataatcgaggatatttataatcccgtggtgaaacggtccatccgaattacagtcaagatcgttaacgcactcatcaaaaagtacggctatcctcgcgaggtggtaatagaaatgccaagagacaggaatagcgacgaggagaaaaagcggattcaagatgaacagaagaaaaacgacaccgaactgaagaaaatcattgagaaggtggagtcggaatacgggatcaaaataactgatacacacttccgcaaccacaagaatttaagaatgaagctgaggctatggcatgagcaggacggacgttgtctctactctggtaaagtcattgatatctccgaactgcttaacgactgctcaaagtttgagattgatcacgtgatccccaaaagtatcagcttcgacgattcccggtctaataaggttttggtgtatagcaccgagaaccagaaaaagacgaatcaaaccccttaccagtatctggaaggcaacgggaaggagtggtcatttgacgaatacatgaatcaggtcatagagctcaaagatcgaaagctgattagtaaagctaagatgaacaaacttctgttcagagaagacatcacaaagattgaggtgttgaaaggatttatcgccaggaatataaacgatactcgctatgcttcccgggtagttctcaatagcttccagaagtactttgagtctaagcaatcagacaccaaagtgaaggtcattagaggcagtttcacacatcagatgaggaaaaagctgcagttaagcaaaaaccgcgacgaatcctatgcccaccacgcagtggatgccatgctgatctgttactctcagatgggttacgaggcttatcgacaactacaggaagacctcatcgatccagactcggagaagattcgggatctggggctttggaaggaaactatcaccgaggcgaaatacgacgaggtcttgtatacagcaaagtggctggaaaatcgtggcaaaattcaggaggccgaaaagaaagtgaagttttggcataaggttgatagcaaagctaacagagccctctgcaatcaaaccataaggggaactcgcgtgatcgacggctccattcagaagatcaacaaaattaacatctactcagtagatgggtataagacgttcaaaaatatgatacagaagggaaaggagaaagactttctgatgtaccggaacgatagaaggagttgggacgatttaatgaaggtctatcgagaatactctgacgccaaaaatgcattcgctgcctaccaggaggagacaggtgactatgtgcgcaagtacgcgaaaaagcacaacggcagcaagatcaccaatctgaaatattgtgcaaaggaacttgggtcctgcattgatatctcacataaatacggattggagaaggacagccggaaagttattctcgaatctctgtccccgtatagaagtgatgtgtactataacgctggcctaaagcaatactacatcgtcggtattaaaaatagcgacctgtgtttcctcaagggggagtattttatagattctaagaggtacctgcagatccttcgtgaggaaggcgtgttgactgagcagcacaccctgaacgacttagccgcaatcggaacagagttccagttttccctctatgaaaatgattacctggaatatgagaaaaacggcgagattaagaccgaacgcttcctttcacggactaaacccaagcagaaaaattacatagagacaaagagtatcgacgcccctaagattaaaaacaagaaacaaaatctggtagggttggctaagagcaaatcgatcaagaagattagagtggatatcctcggaaacaggtattacgcctccaaagaaaagttttctctgatggttgacaaattctga

SEQ ID NO: 2758 - RNA, 3318 nt, synthetic construct
  misc_feature 1..3318: note = Cas9 variant
  source 1..3318: mol_type = other RNA
atggacatggcctggagactgggcctcgatcttgggaccaacagcctgggatgggctgcattgtccttagacgccgcgggtgctcccgatgccatcctggcagccggctctaggattttcggggacggacgggatcctcagtcaggcacaagtctagctgtggaccgccgagcagcccgtgctgccagaaggcggcgcgatagatttaagcaaaggcagcgggcgctcctgaaacaccttgaggcagacggtctgttcccagccgatccggaagtccagcaggctttggccgcactcgacccctacgctctgcgcgcccgagcgctggatgaggccctcagcttacatgaaatagggagagcactgtttcaccttaatcaaaggcggggattccagtccaaccgtaaggctgaccgcggcaaagatgaggacgccggcaagatcgctattggggttgacagattgaaagatgccatcgcagccgctggagcgaggacttttggtgagttcctgcggcagcgacgcgcaggcgccacgggggagaatcagattccttctgtgagaaccaggctacgggctgagacaggagaaggcgccaagggttcggggtatgacttttacccatcacgcgcactcctgaaggatgagttcgacgccatctggcatgctcaagccgaacaccatcccaaagtacttactgatgaggcatatcacagactgcacgagatagtgtttaggcagcgtcctttgcgggcgccaaaggtcggagcttgcaccctcgtgcccggcgaagcccgactgcctaaagcacatccattattccagagaaggcgcctgctcgaggaacttaacgccctgatgatcgttcgggctggcgccgtggcagagagattgacaccggaacagagggacctactgctcctgaaacttaaagataaggggaaggtcacctttaaaagcctgcgcgagaaggtgttgaaactcgacggagatgctcgattcaataaggagagtgaacaccggactgagctgaaaggtgacgaagtagccgcggagatgggcgggaagacacgttttggatccttatggccccatctgtctaccgaacaacagtggacggttattgagagacagcaagccctagagagcgatgctgacgaagcagccttcaggacttggctcgtggagacccacaaactgacagctgaacaggcccgcgcagtcgcgggcgcccggcttcctgctggtcacgggagattcggcttgactgccaccgcagctctgctcgccgcactgagggacggacgaacaccagagggccgcgggcccaacgcccctgctaccgaagcgggacgggtggtggtctactccgaggccgcagctatcgccggttatcatcactcagatcatagaagtggcgaggtttttacggacgccaaggggaggccagcccttccctactatggagtgccgctggatcgtcacattgtacctggcactgcagaccccgatgaaccagacgaggccgcgcgcatcggtcggttgacaaatcctaccgtgcatatagctctcaaccagctgagaagggtcgtgaatcgattaattcgggtttacgggcccccagccgaagtggcactggagctagcccgcgagctcaagctgagcgaagatgagaaaaaggaaagaaacagggaaaattctcggaaccgacttgacgctgaaaagagatcctcaaagttggcagagctgggccagcgcgataatggaggcaacagggccctcctgaaattatgggaggaactgaatcccgagaacatccttgaccgtcggtgtatttacagcgggagacaaatcagtatcggaatgattttctctggtgcggctgaagtcgatcacatattgccttttgacgccactctcgatgactccaacgcaaataagatcctgtgcctaagggaggccaaccgcgacaagcgaaaaagaagcccattcgaggcttggggcgggacaccgcagtgggaagagattgccgaacgggcatcgaggctgccccgcaataagcgttggagatttgagcctgatgctatggaacggttcgccgaggaaggaggctttctcgcgaggcacctggtggacacccagtatcttggtcgcatcgcccatgattacttgcgatgtctgtatccagacaaaggggatggatcttcccacgtatgggtttcacccggcagattaacggagatggtgcggaggaagctcggcctgaacgggcttctgggagaccataatttgggcgcagagcagcctaaaaaccgcaaggatcacagacaccatgctatagacgccgtcgtgaccgctattctcgataggagtatgctgcaacggatccagcgtgcaagcggtgaaggggcctccgacgccgagctactgcgcatcattgtcccagaaccctggacaggattccgagatgacctccagagagctgtggataggatcgttgtggcgcaccgggcagaccatggcactgtagccaaggctgccacccgcggtagagaccagacagcagccaggctgcacaatgatactgcttacggctttaccggggaggcggacgccaaaggaacaccgattgtcgtgcatcgggcacctcttggcgctttgaagaaaccagagcacatagatcaagttcgagaccccctgttaagagccgcactccacgatttcaccgccgggctgtctggaaagccttttgaagaccgcatcgctgccttccccaggcttggcccactggattatcggggtattcgtagagtgagggtcgtggagcctctacaggtaatccccatccgcgacgcggcagggcgggcctacaaaggatataagggcgatagcaactaccgatacgacgtgtgggaactcccagatggtaagtgggagcagagagttctgcagatgtattacgctcatcaatcaggcgaaccgcctaggccccacccagccgctcgcaaagtcttgagtctgcatcgggacgacgtgttagcaattgagagaggggagggaggccgtgaactcgtgagggtcgttaagttttccactaatgagttcacgctggctccccttaacgaagggggagctctgaaaagccggcacgccgataagggcgaccctttccgctatttgtacccatctccctcaacactcaaagcatggcgagcgagagaggtgagggtggatgaactgggtcgggtactagaccctgggtttccggcccgcaagagaaggcgagtcacccggccaggacgtgctgatgccgactga

SEQ ID NO: 2759 - RNA, 3321 nt, synthetic construct
  misc_feature 1..3321: note = Cas9 variant
  source 1..3321: mol_type = other RNA
atgcagtacatcgtggccattgacataggcgtcgctagcgttgggtatgcagtgatcgataagacctccgagacagtaattgaagccggatctaacatcttccccgaggcgtcagctactgacaatcaagaaagaaggggtatgcggcaggcccgccgactgaaacgtagagagaggacgcggctcgatgactttaccaaactttgggaataccacggcctggcaattcctcaggtgaaaaagaacgatatcgtcgggttgaaagtgaaggccttatatgagagtataagcctggacgaggtttacctaatcctctattcctacctgaagcatcgcggaatttcttatcttgaagatgtggaggactcgtcagtcagcggcagtacagcttacgcaaatggtctgaaattgaacgccaaggaactcgagaaaaatttcccatgcgagatccagaagtacagactggaaaacattgggaaatataggggacaaatccagatagaggatgaccagggcgaaaagctggatctctccaatgtgtttactattggcgcttacaccaaggagatccagcaaattttagacacacagaaaaagtatcacgccgaaatcgaggatgagttctgtgaaaaatacctgaagatctttacccggaaacgcaagtattacgaggggccgggaaacgaaaaatctcgaactgactatggtaagtacacaaccagacttaaggagaatggcgaatacattacggagaaaaacatattcgagaagttgatcgggaaatgcagcgtatataaggacgaactgagggcggcatccgcctcatacactgctcaggagtttaatctactcaacgatctgaataaccttaccgttaatggacggaaactggaagagaacgaaaagcatttgattgtggacaaggtcaaaacaagtaacactatcaatatgcgtaagataattgccgatgcaatgggcgagaaaatcgaggagttctatggtgctcgcatcgacaagagcgaaaaagaaatttttcacaagttcgaggtgtacaacaagatgagaaaagccctcgcggccatccatgtgaatattgaggaattttctagggatgacctggatgagatagggtatatcttaaccattaacacagacaaggaagcaatgatggaggctttcgataattcccggctggaactccccggagagatcaaaaactgtcttatctcactgcgaaagaccaatggcacgttgtacagcaaatggcacagtttttctctaaagattatgaacgagctgatacctgaaatgtatcgccagccaaaggagcaaatgactctcctgacagaaatgggcgtcatgaaagggcagaccgacgagttcgaaaagaataaatacatccccgttgatgtggcctccgaggacattttcaaccctgtagtgagaaggagcgtccggatctcgtttaagattcttaatgctctgatgaaaaagtacggaactttggacgaggtggttatcgaaatgccacgcgatagaaactctgacgagcagaaaaagtgggaaaaggagacacaaaagaagaatgaaaaagagcaggagtatatagaaaacaagctcgccaccgtgtacgatatcaggctgtcctcagcagacttcagtagccagaaacagttaaatctgaagctaaagctctggaacgagcaagatggtaaatgcctgtattccggcaagattatcgaacccgaggaccttattaaacactctgagttgtttgaaatcgatcatataattcctcgtagcatctcattcgacgatagtcggtccaacaaggtcctggtgtaccgaacggagaatcagaacaaagggaatcagaccccatattactatctcacacacactaacagcaagtggtcttttgaacagtacaaggccctggtaatggaccttagtaaaaagaaagagtacggactgtcaaagaaaaaggttagaaatttgctctatagcgaagatattaccaaggctgacgtgctgaggggcttcatcaaccgcaatataaacgatacatcctacgcggcacgggtcgtgttaaatactgtccaaggttattttagagccaaagagatggggaccaaggtgaaagttatcaggggctcttacacacatcagatgcgcgtgaacatgaagctggacaaagaccgagagaagtcgtatgctcaccacgccgtagatgcaatgctaattgccttcagccagctcggatacgaggcttatcggaaactgcagggcgaatttatcgacttcgaaaccggggagattcttaattccgaaaagtggaaggatcaaatgtcagacgaggtctacaaacagtacttgtatcgtaagaaatggagtaacatcagaaatgagataactagggccgaaaagaacgtgaaatactggtattacgttgatcataagtctaatcgcggactgtgtaaccagaagattcggggtacgagagtgtatgacggcaaaatctacaagatcaacaaactcgatattaggaagaaagagggggcagcgctgtttaagaagttagctttcagcgaaaaagagtccgaccgagaaaagctgcttgtctataaaaatgataagaaaacatacgaggacttggtgcgcatcatgcaggattactcagacagcaagaacccgtttgtacaatatgagaaggaaaccggagattacgtgcggaaatatgccaagaaacacaatggccccagaattgacaagctcaaatacatagacggtgaggttgggtcttgcatcgatatttcccataagtatggctacgaaaagggaagtaggaaagtcgtgctggagagcctagtgccttatcgtatggacgtctactacaagaaagaggaacagacttattacctggttggcatcaagcagtctgatgtgaaatgtcaaaagggggagtatgtgattgacgaagatgcatacgccatcaacctcgtaaaagagaagatgatacagcagggacagaagcgctccgacctggaatcacttggtttcgagttccaattgagtttttataaaaatgatatcattgagtacgaaaaggacggcaaaatcgtccgggagagattcctgagcaggaccatgccaaaggtgaaaaactatattgaaacaaagcccatcgatcgagctaagtacgagtggcacgaccggaaattagttgggctcggaaagaccaaacgcataagaaagtacaggatggatattctgggcaattattacctttgcaacaaagaagagttttcgaagtattgttga

SEQ ID NO: 2760 - RNA, 3324 nt, synthetic construct
  misc_feature 1..3324: note = Cas9 variant
  source 1..3324: mol_type = other RNA
atgggctacaccgtggggctggacatcggagtcgccagcgttggtgtggctgtactcgatgagaacgacaatattgtggaagcagtctccaacatattcgatgaggccgacacatctaataacaaggtgagaaggactcttcgggaaggccgccgaacgaaacgtagacagaagaccaggatcgaggattttaaacaactgtgggaaacatcagggtatattatcccccacaagttgcatttaaatattatcgagctgcggaacaaaggactaactgagctcctgagtcttgacgaactgtactgcgttttgctcagcatgctgaagcaccgcggcatatcctatctggaggatgcggacgatggtgaaaaggggaatgcttacaaaaagggactcgccttcaacgagaaacagttaaaggagaaaatgccttgtgaaatccagctggagagaatgaagaagtatggcaaataccatggcgaatttattatcgagattaatgacgaaaaggagtatcagtctaacgtgttcaccacaaaagcatacaagaaagagcttgaaaagatctttgagacccaaaggtgcaatgggaacaaaataaatactaagttcattaagaaatacatggaaatctatgagcggaagcgcgaatactatattggaccaggtaacgagaaatcgcgaacagattacggcatctataccacgagaactgacgaggaagggaattttatcgatgagaagaacattttcggaaaattgataggcaagtgttcagtctacccggaagagtatagggccagcagtgcttcctacaccgcacaggaatttaacctgctaaatgacctcaacaatctgaagatcaacaatgagaaacttacagagttccagaagaaagaaattgtggagatcataaaggacgcctctagcgtaaacatgcggaaaattatcaagaaggttatcgatgaagacattgagcagtactccggtgctcgtatcgataaaaaggggaaagagatttatcacacttttgaaatataccgcaagctgaaaaaggagttgaagaccatcaatgtggacattgattcattcacaagagaagaactcgacaaaaccatggatatcctgacgttaaacactgaaagggagagtatcgtcaaggcctttgacgagcaaaaattcgtgtatgaagagaatctgattaagaaactcatagagttccggaagaacaatcagcgactttttagcggatggcattctttctcctacaaagcgatgctgcagttgatccccgtgatgtataaggagcctaaggaacagatgcaactactgacagagatgaacgtctttaaatcaaagaaagagaagtacgttaattataaatacattccagaaaacgaggtggtaaaggaaatctacaatcccgtggtcgttaagagcattcgcaccactgtgaaaatcctcaacgcactgataaagaaatatggctaccctgagagtgtggtcatcgaaatgccaagagataagaactctgacgatgagaaagagaagattgacatgaatcagaagaaaaaccaggaagagtatgaaaagatccttaataaaatttacgacgagaagggcatcgagataacaaacaaagattataagaagcagaaaaagctggtgttgaaactcaagctgtggaatgaacaagaggggttatgcctgtactccggtaaaaagattgccatcgaagacctactcaaccaccccgagttctttgaaattgatcacatcatacctaaaagcatctcgctggacgattctaggtccaataaggtacttgtttataagaccgagaactcaattaaagagaatgacacgccataccattacttgacccggatcaacggaaagtggggcttcgatgaatataaagctaatgtgctggagctccgcagaagggggaagattgacgataaaaaggtcaacaatctgctttgtatggaagacatcacaaagatagatgtggtcaaaggatttattaaccgtaatctgaacgacactcggtacgccagtcgagtggttttgaacgagatgcagagcttctttgaatccagaaagtattgcaataccaaagtgaaggtaatcaggggctctctcacataccagatgcgccaagatctgcacctgaaaaagaaccgggaggagagctattcacatcacgcagtcgacgctatgctgatcgccttcagtcagaagggttacgaagcgtatagaaaaattcagaaggactgttacgattttgagactggggaaatcctagacaaagagaagtggaataaatacattgatgacgatgagttcgacgatatactctataaggaaaggatgaacgagatccgcaagaaaattatcgaagccgaggaaaaggtgaaatacaattataagattgacaaaaagtgcaaccgaggcctgtgtaatcagaccatctacggaacacgggagaaggatggcaaaatacacaagatctccagctataacatttacgacgataaagagtgcaattctcttaagaaaatgatcaactcagggaagggaagtgacttgctgatgtataataacgatccgaaaacctaccgtgacatgctcaagattctggaaacttacagctccgagaagaatccctttgttgcatataacaaagaaacgggtgactacttcagaaagtattctaaaaatcataacggccctaaggtggagaaagtcaagtactattcggggcaaatcaacagctgtatagatatttcccacaagtacggacatgctaaaaattcaaagaaagtggtattagtgagtctgaacccatataggacagacgtttactacgataatgacaccggcaagtattaccttgtcggtgtgaaatataaccacatcaagtgcgtggggaataagtacgtcatcgattctgaaacttataacgagttgctccgcaaagagggcgttctgaatagcgacgaaaacctagaggatttaaattccaagaacattacctacaaattctcactctataagaatgacataatccagtacgaaaaaggaggcgagtactatacagaacggtttctgagcagaattaaggagcagaagaaccttatcgagaccaaacccattaataagcctaacttccagaggaaaaataagaaaggggaatgggagaacactcgaaatcaaatcgccttggctaagacaaaatacgtgggaaagctggtgacggatgtattaggtaactgctatatagtcaacatggaaaagttttctctcgtggttgacaaatga

SEQ ID NO: 2761 - RNA, 3324 nt, synthetic construct
  misc_feature 1..3324: note = Cas9 variant
  source 1..3324: mol_type = other RNA
atgggctacaccctggggctcgacatcggaattgccagcgtgggtttcggccttatagataacgtcgacgggaagatcctggagtccggagttagattgttttcttcagctgatcccgacaataaccagacaaggcggagtagccgccaagcacgacgtttaaatagaaggaaagtgcaccggctggaacgcgtagcccatctactcgaggaagcgggcttcgagaagggtgaagtgctggctcctactccatatcaccttagagtcaaagggctgacggagaagttgtccaaaccggaggtgtacgccgcactctataacctgatgaagcataggggaatttcttacctggaagatgttgagctcgacgaagccgattcgtcaagcgtgagtcagaatgtcgagttactgaaggagtattacccctgcgaaatccagcttgagcggtatgaagagtacggccagattcgcggcatcatagaaacctacaacaaagacggggagaaggagtccttggtgaatatctttcctacaggagcttataaaaaggaagcagaggccattatcctgaaacaaggtcagttctacccagaactagataaggtatttctcgagaagttcactgaaattctgaccgttaaacgaccctattacgtgggccctgggaacaagaaatctagaacagactatggaatctacagggagaatggcgagacccttgaaaacctgtttgatatattgattggtaagtgtactatctatccacaggaggctcgggccgcgaaattcagctacacagcacagctctttgacttcctgaatgatatgaacaatatttccatcgccggggaaaagttaaccgaggtccaaaaacgtgaaatctaccaccagattatgtcaagtaagacggtgaacatgatgaagataatcactaaagtgaccggatgcctgaaggaggaggtcacaggctatcgcgttgacagcaaatacaaggctgaatttcattctttcgcctcctatagacagtttaggaataaaatgctcgactacggcttcgatgtgcagactcttaacgtagagatgttcgacaagctggcagctaagttgaccctaaacacagaatatcaccaaattatcacccagctggagtcactcaatctggggcttagcaaagagctgatagaaaagattgccgattttcggaaaaagaaccgaagtttgttctctaaatggcactccctcagcctgaaggcgatgaatgaggtggtcgacgaattatggtcgacgtctaagaaccagatgcaaatcttttccgagctgggaggtttcaaatcaaatatcgaagtgtttaagggcctaaaatacattcccctcgatgccatggttgacgagatctataaccctgtggtccgctgtagtattagagagagcataaagatcattaatgcactgcttaaaaagtacggggctttggataaggtggtaatcgaaatgccaagggactccaacgagaaagaagagaaggatcggatcactaaactgaataaggaaaacgacaataaaaagaaacaggccattgagaaggctcgcaacgagtacggattcggcgaagaggcctatagacagcagaatgatctcaacacaaagctgaggctttggtacgaacaaaaacagcgttgcctgtattctggtgagataatcaagatttttgacttgatcaaaaatccgcatctcttcgacattgatcacatcatacccaagagcatctcatacgacgatagtctgtccaacaaagttttatgttatgcaaccgaaaaccgggagaaggggaatctgactccttaccgatattttaagagaaaagccagcctaacatggaactacgaggcttacaagtcttatgtgattgaactctacaaagacggcaagggagatctgtcaaggaccaaacttgagttgctcctgttcgaagaggacatcaataagtatgaggtccgccagcggtttattaacagaaatctggtggatacgaggtacgcgagtaaggtcgtgttaaacaccctgcaggacttcatgaaagaaaattatccaacaactaccgttgaggtggtacgcggcaagtttacagcacaacttcgacggcattgggggatccgtaaaaacagagatgaaaatcacgcccaccatgctatagacgccttgattatcgcatgcgtcccccacctcagcctgtggaaggagcagaaaaaggtgttctccactgatgagttcagggttgacgaaaccacaggagagattatcgaacagtcttacaaccagctaacctatcaagagcctttttcgcagttcttttaccagctggaaaaggtgagcatagattgtcgctactcctataaagtcgaccggaagttcaatagacaggtggccgacgctactatctactcaacgaggcaaggtattgtaaaacagacaagtggcgataagtcttttaccctcgacagcaactccaaagagcattatgtgatcgccaagattaaaaatatctacgaagatgttgacgcaaagcgattcatggatcgctataagaaagacaagactcagtttctgatgtaccaccatgatccacaaaccttctcaatacttgaggacgtcatgaaaacatatcccgataagaaaaacccgtttcaggcgtaccggttggagtacgggcctattagaaagtatagcaagaaaggaaatggcccccagatccagtctatcaagtactatgactccaaactgggtcaacacattgaattaaagcaggctaaccagagtaccaaaaaggtggtgctccagagcctgaacccatggaggtgcgatatctactataataagaaagacaagcgttacattgccgcagggcttaaatatgccgatctgtcttaccaaaagggcactggattgtacggcatatccctccagcgctatcagcagatcctgaactcagagaaaattgaactaagtatcgagcaaattgaactgctcctggaggggcggcttaatgagagcaacttcgaattttgtttctcgttgtacaagaatgactttatccagtggaacgacgagaataaccagacattccaatatagattcctggctaggaatttatcctctcctaaccgaatagaagtcaagcccatcaataaaagcaagtacgataaacaggccgagggactcaagacgctgaaaaagggtcttaaccggttttataagatttcagttgacgtgctgggctaccagcacttcatcaaaaaggagaaactaaagctcacctttaaatga

SEQ ID NO: 2762 - RNA, 3330 nt, synthetic construct
  misc_feature 1..3330: note = Cas9 variant
  source 1..3330: mol_type = other RNA
atgagccactacgtgctgggcctcgacatcgggattacctccgtcggatatggtataatcgatcttgacacaaacgatttcattgactacggcgttagactgtttaaggaagggactgccgctaataacgaagataggagaaattctcgctcacgacgtagattgttaagtaggaaacatacgcggctgatggacatgcagaaggtgctaaaagaggcaggaatcatgaccgaaagctattctcccctctccaacgtatacgagattcgcaagaaaggcctgacaaaggaacttactaatgatgagctgaccgccgcgatcttgcacataacaaagcatagaggttcggtgatcgagaccgtcgaagacgatgaggctgccgcaaaagaaactggggagctcaagtcaacactgcacgagaacgccctgctcttagctaataacaaattcgtgtgcgaaattcaactggagaggcttaataccgaaaacaagatccggaatcataaaaacaattttaagacgaaggactatgttgcagagttgaaagaaattctgaaccaccagaatctaagcgaggaggtgaagaacaaaatcatacagattgtcgaacgcagacgagcctactatgagggacctggcagtttcaactccccaactccgtacggcaggtttatcgaagtgaatgggcaggtacaagagattgatctcatcgaaaagatgcggggaaaatgttctgtttaccccgacgagttccgtgctcctaagatgagcatctccgccgatctgtttaacattcttaatgacttcaacaatctgttggtgcagggtgagaaactccaggaagaggacaagaagaacctgttaaaaataatcaatgataagggctcaattaccctgcgccagatcagtaaaaagctcgaagtcaacgaggacgaaataaaagggtatagaattgataagaagggaaaagcgctttttacagagttcaagggctacaaaatcctgaagaaattgtttctaaattgcggtcaaagcatctctctggaggactatgaaatgctcgatgagattatcgaaattgtgactaagaagaaagggatagacgagaggaaggatgcactgaaagagcttaagtgggacctgtccgatgacatcattaactcattgagcgaagtgaccggaatcgtcggctaccacagtctctctctgaaagccatccgggagttagattccgaactgtataagacaagcctaaatcagatgcagctcctgcatgagcttaagatgttcgacaaaaaccgaccatcgtacaagggcaaaaagaatattgttgctgaccccgaagccatattgtctcctgtggcaaaacgcgctcagaacgagacctttaaggtaatcaatgccctgcggaaaaagtatggggagttcgattccattgtggtcgaaatgacgagggacaagaactcacaagagcagaaaaagcggatcaacgatagtcagaaagcgctcgaaagcctgaataaggaggtggaccaacttctgcagcagaaaggatacgatccacagaaggttaagggtaaaactaagcaaaaagtgcgcttgtacatgatgcaggaaggcaagtccgcctatacactccaggagctggacttacacagagtcattaaagatgacaagtacaccgagatcgatcatataatccccatttctatcagcctggacgattcacagagtaacaaggtgctagcactccactccgaaaatcaacagaaagggaacctgactcctttcatggcttttcacacaggaaggttcgccgacatgggctgtacctggaataagtttaaagagaacgtacttagcaataagaactataaacataagaagaaaaataacttgctggatgaacgtgacattaataagttctctgttatccaggagtttataaaccggaatctcgtggacacgtcatacgctaaccgagtcgtgctgaataccttaacagattatttcaaagacaacgaaattgatactaaggtccacaccgtgaacggtaaactgacagacctttttagaaagaggatcaatttgaaaaaggatcgcaacgaggactacctccatcacgccattgatgcactgatcgttgccagtataaagaaactacggctgctcgacgggtatctggctaagtacggcttcgagactctttacgatgaaatgaccggagagatcaaagaaattccagaggacaaggcgtttttcgatgacaaatatatcagatacattttgaatctgaagacaatctatgagagctccaacatgtactataggggcatattagaacgcgaggaactcatttaccagccgatcaagatctctcataaaattgataccaagcccaatcgaaaagtgtcggacgagactatctatagcacgcggattatagacaacgaagatcacctgatcgagaagtactccgacatttacgatcctaaatttaagaatcttacagaggacatcctgaacggggaaaagaataaatatttgatggagaagaacgatccacaaaccttcaatattctcaaacagatcatatttaaccactacaatacttataaggactcaaaagaatactataagatcgagaagaaaaaggaaaaagagattatcaagctggtaggaattaaccccctaagtctgtacaaagaggaaaatggtcctatcaagaagtattctaaaaagggcaacgggccagtcataatgagcatgaaatacgattccgagaagctcggaaaccatattgacatcacccccgattcagccaaaaataagaaagtgatcctgaagcagattagcccgtaccgtacagacttctataagtgctctgatgaaaaattcagatttgttaccgtgaggtacaaggacgtccactatcagaaatccatagacaagtactgtatcgataaagagtggtatcaaaacgaaaagaagaataaaaagattgacgagaaagcagagttcctttttagtatgcatcacgatgaattgatcggcattactcgcaaggagagcgaacagttcatctacgacgagtctaaagagaaccacggtgatcctcggtatcatgacggggtgaagcccgaaatactgaagtttacagctacgaataacgataccaaaggcatcattgaggtaaagccattatacacttactccgcctatagactcaaacctacagtgctgaatgttaagaacatcaaaaagtacgcaaccgacgtccttggaaatctgtatgaagtgaagcagaacgagctaaaactcgagttctga

SEQ ID NO: 2763 - RNA, 3333 nt, synthetic construct
  misc_feature 1..3333: note = Cas9 variant
  source 1..3333: mol_type = other RNA
atggccgagggcaagaaaagaatctggaggctgggggctgacctcggagcaaacagccttggttgggccgcgattgaactgtccgctcccgtgaatggcaagcctatagccatcttggcagccgggtctcggattttctcagatggacgcgacccaaaaagtggcgctagcttagcagtcgatcgacgtgacgccagagctatgaggcggcgcagagataggtttaagcagcggcaaaaagccctgatcaagtacctaattgcggacggtctcttcccggcagatgaggccgctcgcaacgccatggcagctatcgacccctatgccgttcgagcgagagccctggatgaagcactttccctgcctgagttggggagggctctctttcacctgaatcagcggcgtggattcaagtctaaccgcaaagccgacagaaaggctgatgacgatgccggcaaaatagcaatcggcattgacaggacccgggacgccatcgctgaagatgaggcggacgcaggggccgagccaggatcgtggacatttggtaagtggctgcatgaacgacgcctcaaaggccagtcagtgagaactaggttacggcccgagagcggggaagatgctaagggagacggctacgatttctatcctgaccgcgccctgatggaggaggaatttgatgcaatttgggccgctcaggccccacaccatcccgacgtacttacgaatgatgtgcacgacagattgcatgagatcatattctaccaaaggcctctgaaggcaccacaggtcggtatgtgcagtctaattccgggggatcgtcggctccccaaagcgcaccctctgtttcagcgaagaaggcttctggaagagttgaacgctctcatgatcgtgcgcccaggagaagttgcccagcggctgaccagagaggagagggacattttactgctcaaacttaaagacaagaataaagtgtccttcgcaacactgcgcaaggccttgaaactagatcccgacgctcgatttaacaaggaatctgaggatcggactgacctgaagggcgatgaagtcgccgcagtgatgggcagcaaaacccgtttcgggaatctctgggtacacctgtccatcgaggctcaatgggacgttcttgccagactggatgcggtggaatcagacgccgaggatgctgcattttgtgcctggttggtcgagacatatgctctcacccctgaacaggccagggcagtggcgaacgccccactgcccccgggatacggtcgcttcggcgagactgctacacggaagttaatcgaagccctgagagacgggaaaaaggatgacagggtgctagtctatagtgaggcagttaccgaagctggactcggccatcacagcgatcgacgcacgggtgaggtgttcgaggacgccaaagggcggcctcagctgccctactacggcgtagcacttgaaagacatattatgccaggaactggcgacccttctgatcccgaggaaatgagggtggggcgtttgaccaatccaacagtccacataggactgaaccagctccgccggatcctgaatgtgcttattagagcctatggtccccctgctgagatcgcgatagagctggccagggaattgaagctcactgacgaggataagaaacgaattaaccgggaaaataacgacaaccgcatcgcagctgagagaaggtccgaaaagctgttagccatcggccaagccgattcaggggctaatcgggcactgctaaaactctgggaggagctgaacccagccaatgttcttgaccgaagatgcatttacagcggacgccagatcagtattgatatgttgttttctgcggctgtggaagtcgaccacatactgccgttcgccgcaaccctcgatgactccaacggcaataagatcgtgtgtctgagggaggccaaccgtgaaaaacggaagagaagcccccatgatgcttggggtcactcggcaaggtgggacgagattgccgcgcgcgctgcccagttacctcgaaataagagatggcggtttgaaccagatgcaatggacaaattcagggacgaagggggctttcaagcccgccatctggtagatacacagtatcttgctcgtttgtctagagagtacctcgccaccctgtatcccgagaagggagagggctccgggcacatctgggtttcacctggacggctaacggaaatggtgaggcgcaaactgggtctcaacgacctgcttccagatcataatttcggcgggggagcagaccaggctaagaaccgattggatcacagacaccatgccatcgacgcggtcgtggtcgccattgtggatcggggcatgctgaatgcaatagctagggccagtggtcaggagggggctgaaggccgcgagagaatcattatccccgagccgtgggacggatttagggatgcattacgggaaactgttaaccgtattacagtgagccaccgcaccgaccatggcactgcctccaaagccgggctccctaagggaaaggatgctacagcgggccgactgcacaatgacaccgcatacggtttcacgggggacaccgatgccaaaggaaactctatcgtagtcagaagggtgccacttagctcatttaagaaactggctgacttggatcggatacgcgacgccgatctcaaggcagccctgtatcaacacctaaatggcctggagggtaaggctttcgaaaaggcgctcgccgagtttcataaactggagtggcacaacttcggcggggttagaagggtgcgggtcacagaaccccttactgtgatccctattaaggaccgaaacggaagaatctacaagggctacaaaggggatagtaattatcgctacgacgtatgggagttgcccgatggaaagtgggtgaccaactggaaaaatgaagcaggcgaggctatgtccagcgttatttctatgtttgacgcccatcagtcaagtgaaccacctaggccccacccagcagcccggaagatcctgagcttacatcagaacgatctcctggctatagagcgtgagggtgaagacagaaaacttatgagggtcgtgaagttcgggcagtccggacaaattacactggccgagcaccagcaggcgggcgatctaaagaaacgcgacgcagtgtctaatgacgatgacccgttcaagtattttgcccctacttcgggtggcctcaaaaaggtcaaagctcggcaggttcgaatcgatgaaattgggagagtgctggaccccggattcccagccaggaccgctcgccggaagacaagaggctga

SEQ ID NO: 2764 - RNA, 3333 nt, synthetic construct
  misc_feature 1..3333: note = Cas9 variant
  source 1..3333: mol_type = other RNA
atgaccgccagaacacacaagatctggaggctgggcgctgacctcggggcaaacagccttggatgggccgcgattgagctgtccgctcccgtggatggtaaacctatagccatcttgcatgcaggctctcggattttctcagacgggcgcgatccaaagagtggagccagcttagctgtcgaccgacgtgatgcaagagccatgaggcggcgcagagacaggctgcagcaacggcagcgcgctctaatcaaatacctcattgccgatggcctgtttccggcggacgaaaatgagcgaaaggcaatggccactatcgatccctatgctgttagagccagggcacttgacgaagctctgacgttgcctgaggtgggtcgggccctcttccacctgaaccagcgtcgcgggtttaaatccaatagaaaggcggataggaaggccgacgaagatgcaggaaaaatagctatcggcattgaccggacccgagacgccatccgccaggctgaggaggaagccggcgcagagccagggtcttggacatacggaaagtggctgtatgaaagaagggcctcggctactgatgcgaacgcaattccctcagtacggacccgcctcagacctgagacagacgagcatgccaaaggtgatggctacgacttctatccagggagggctttaatggaagccgagtttgcagccatctgggaagctcaagccgcacaccatcccgatgcgctgaccaatgaggtgcacgaccgtcttcacgaaataattttctaccagcggcctttgaaggctccacagatcggagtctgcactctgattcgaggcgatcagagactaccgaaagcccatcccctctttcaaaagaggcgcctgcttgaggagctgaacgcattgacaatcgtgcggcctggtgaaatggcccagagactcaccagggaggaacgcgacacgctgttcttaaagctgaaagataaggctaaagttagctttgtgagtctccgaaagactcttaaactggacccagatgcccggttcaataaggagtccgaaaaccgttctgacttgaaaggggacgaggtcgcagctgccatgggagcgaagaccagatttggcaataggtgggtgcacctaagcatcgaggaacagtgggatgtaattgcccgcctggaggaagttgagtccgacgctgaagatgcagcctgtcgggcttggctcgccgcaacattcgacctgactcccgagcagataagagcggtgaccaacgcccctcttccacccggctattcaaggtttgggaaggtcgctacacaacgactgatcgatgccttgcgcgacggagagaaagatggtcgggtgctcgtgtacagtgaagcagtcgctgccgcaggcctggggcatcacagcgacttaagaaccggagagattttcgaagatgcccagggcaggccgcagctgccttactatggtgttgctctagagcgtcacatcatgcccgggacgggcaatccagaccattctgatgagatgcgcataggacggctcactaaccctacagtgcacattggcctgaatcaacttagaaggatcgtaaacaccttgatccgagcgtacgggcccccagccgaaattgcaatcgagctggctcgggaactcaagctgactgacgatgacaaaaagcgcattaataaagagaacaacgaaaatagacttgccgccgagaagaggtccgagaagctgttgacaataggacggcccgacaccggtgctaaccgagcactcctgaaattatgggaggaactgaatcctgccaacgtgctagatagacgctgcatctatacgggcacccagatttcagtcgacatgctgttcagcgcggctgtggaagttgatcatatcctcccatttacagccactcttgacgatagtaatgggaacaagatcgtgtgtatgagggaggcaaatcgtaccaaacggaagcagtctccgtacgaagcctggggacacacagacagatgggaggagattgctgcaagggccgcgcagttgccccgcaacaaacgatggagattcgaacctgatgctatggagaagtttaaggacgaatccggcttccaagcccggcatctggtcgatactcagtatctcgcaaggctgagccgcgagtacttagaaaccctgtatccaggttcgggggaggggtcttcccacatatgggtgtcacccggacgtcttacagagatggtaagacggaaattgggcctcaatgacctgctacctgatcacaactttgggggaggtgccgaccaggctaagaataggctggatcatcgccaccatgccatcgacgcagttgtggtcgctattgtggaccgaagtatgctcaccgaaatcagcagagtctccggcctggagggggccgaaggacgggagaggattatcataccacccccgtgggatgagttccgcaacgaccttagaactgcggtgaatgccatcacggtttctcacaggacagatcacggcaccattagcaaagcaggtttgcctaaggggaaagacgctactgccggccggctgcataacgataccgcttacggatttacaggcgaaaccgacgcaaagggcaattcaatcgtggtacgtcgcgtcccattagccagtttcaagaaactcgccgatctggaccgaattagagatactgaccttaaggctgcgctgtaccagcacttggagggactcgaaggcaaagcatttgagaaggccgtgatggatttccccaacctggaatggcatccttttggtaacgttaggcgggtgcgcgtcacagaggtgctatccgtaatccccataagcgaccaaaatgggagaatttataaaggatacaagggcgactctaactataggtacgatgtgtgggagctgccaggtggcaaatgggaagctgaggttgtctcaacgttcgacgcccaccagcctgattgggtgagtaagatccggagccgatcccccaccgcaagaaaggtgctctctctgcagcagaatgaccttattgccgtcgaacgcgctcatgagactagggaattgatgcgggttgtgaaatttcgtcaaaacggggagatcacattcgcgccaccgcaggaggccggatcgctgaagagaagggatgcaacccctaatgaagacgatcccttcaaatattttgctgtggccgcaagctccttacagaaggccaaagctcgccaggtacggatagacgagctcggccgagtcctggatccagggttccccgccagaacagcgaggcgcaagactcggaagtcaacctga

SEQ ID NO: 2765 - RNA, 3333 nt, synthetic construct
  misc_feature 1..3333: note = Cas9 variant
  source 1..3333: mol_type = other RNA
atgagaatcctgggcttcgacattgggataaccagcatcggatgggcctacgtggagggtgaagaactcaaggattgcggcgtcaggatttttacaaaagctgaaaacccccagaatggggactcccttgcagcccctcggcgcgaggcgcgaggagttcgtagaaggctggctcggcgcaaggtgagattgaacgtaatcaaaaggttactgtgtaaggagttcggcctaaatctctctgattattttgccaacgacggtgagctgccaaaagcatacgagactacgaaggataccaagtcaccgtatgaacttcggagtctggccttggagcaaaaactcgaacccaaggagctggctcgcgtgattctgcacatcgcaaaacatcgagggtacggaaataagcacgccaaaagagacctcgaggctgaagagaaggccaagaaagcggcagaaaaggcccctcaggagaaagaaagcacaactaccaacggcgattccaagaaagagcaggagaaggtcttaaaagctctgtatcagaatgaaacacttttgaagaagtaccaaaccaactatcagactaataacaaaacaaatgacgagaccaacaataagacgatattcctggtgggcaaatacctatacaaggaatttcaggataaagggcagaggatccggaacactaccaataactatcaacatacaatgcgtcaggagtggctcaaggacgaactggagttcatttttaagaaacagaaggatttcggagccactttttctgagaacttcgaatcgcagatccttgagaccgcattttaccaacgcgacctgaaatcattcgaagataaggttggtaaatgcgtgttttatgagaatgaaaacagagctccaaaggacagcttgagtgccatggagttcgtcgcgctcacaaggattatcaataccctgaagaacttagagaaaaagtccaaaaatctgggcataggggaaacgtacggaaaggacaaaattcaggagatcctcaagattgtgcttgataagggcgaaatgtcttataaagagctgcggaagatcttgaaactaaacgagagcatcctgttcgccaaggactccaaactcgattacactaagggtatgcaggaagcagagaaagctaagtttattgaactgaagaatcttaaagccttcaagaaagctatgggaggggacttttcaaagttcccccgagaggaactggataaaatagccacagacatcgtattgattaagagtaaggagaacctcgcaaagaagctgcaaaattatagcgccttatctaaagagcaggttgaagctctgtccaacctaaattttgcgaagcacatcgatctctcactgaaagcacttgacaagatattgcctttcatgcgcgagggcctgagctacgatgaagtggtcaagaaagtgggcctccaggagcatagaaagtacaaacagaagggggaatttctgattccacttaaagagtatgagccctacctggccaaccctgtggtcgctagggccttgagtgaatatcggaaggttctcaatgcactgttacgcaagtacggaaacgtgcacaaaatccacctggagttcaccagagaagccggtaagaattatgacgagaggaaaaagatcgaaaaagagcaacgtgagcattttgaagctaaccagaaggccattaaacagcgggagatcctaggcctcccaattaacggggcaaatatactgaagatgaaactttggatcgaacagggagagtgttgcgtatactctggcgagaaaattacttccaagcacttctttgatagcaacgcgttgcaagtggaccatatctatccgtactcgcgatctttcgacgattcctacatgaataaagtcctggtgtttgctaaggaaaaccagaataaactcaacaagacacccttcgaggccttcggttcagacaaggaaaaatgggatagaatcctgagtttaagcgcaaagctgcctaaacagaagcagaggcgcatttccaataaagactttaaggataaggagcttgggttcatagcccggaacatcaatgacaccggctatattgctagattggcctctcaatggacgaacaattgtctcaaatttgaagatctgagggagaacgaggttaccatcgcaggagaaaagggcagcaaaaatcacctagaggtgatttcagggcagctgacaagtatgctccgccactactggggactgggtgacaaggatcgaaacaatcatcttcaccatgctgtcgacgccgtgatcatagcgtatactaacgccaaaaccatcaaggctttcgcagattttaagaaaaaccaggaacagaatcgggccaagttctacgctaaacaaatttccgagcaggaatataagcgtcagagaaacccatttgagccctgcgccaatttcaggcaacgcgtagaggagaaaatcaacaagatttttgttagcaagcctccacggaaaagagcaaggggcgcgttgcacaaggaaacattcgggtctatctgtctggacggaaataacaattgggtggcccgatttaaaataaagagtaaaaaggaacaggaggatattactaaagaaaaggctaccaaggccaaatacaaggacgagttcaaaggcgaggaaaacatccgcaaggcattaaaactcggtaagattcggagaatcaataacacacagaaggacatagctatcggggataaaattgtcaagaatgagaccatggtgagggtcgacatctttaaagataagaaaggcaagttctatgccgtgcccatttacactatggacttcgcactgggaatccttccgaacaaggccgttgctacgggcgaagatgaggacggggtgataaaagattggattgagatggacaagacaaaatacgaattttgcttctcactgtttaaggatgacttgatcaaagtacgtaagaagaaaatgaaggaggcggaactctgttatttcgtcggatttgataccgacggtagccgcatcattgtggccaaacataataacgattaccagactatgaccgagaatgaatgcaagctgttcacactaaaagagaagaaaaagaagcagaaaaccctgaacgacgaggaagacaaccaagagcggatcgaaactgagtataagattataggcgggagaacaggaatccagaatctcgaaacgtttgagaaacaccaggtttcccctctgggcgaggtgcaaaaggcagagttcgaagataggcaggaaattaaacttaagtcttcgcccaagggtaaagactga

SEQ ID NO: 2766 - RNA, 3333 nt, synthetic construct
  misc_feature 1..3333: note = Cas9 variant
  source 1..3333: mol_type = other RNA
atgagcgagaagtacagactgggcctcgacgtggggaccaactcccttggatgggccgtcatcggtctgaaagaagatgttccctcttcagtgttggctacaggcgtaaggattttcagtgaggggcgggacgcaaagactaaaagcacgttaaaggcctcccgcaccgaaaaacgatctgcgcgtagaaggcgggatcgctttctgcagagacaaacattcctaatatcggagatggtgaagtcaggactctttcctaaggacatcgtcgaacagaaaaatctggagcttctggatccatatgagattaggttcaaggctttgactgaacaggtgccgctccaccatctgggccgggccctgtttcacatcaaccagcgccgaggtttcaaaagcagtagaaaggacaaatccgaggaaaccacatctggggttgtgagcaagtccgtcagggcactctacgaggagatgcaattaattaatcccgcccctgtgatcgatgacccaaaggctctgtcaaaagaagaacggcgtgaaatacgcgtacaggaggcaagtagcagagaagaggcccttgttaccttggctgagcagaagggagtgacttttggcgccttcctgtataggcggctacagtctggcaaatccgtccgagcgcgcaaggatgcagactcacaactctacgatgtgtatcccacaagagaactgcttaaagacgagtacagcaagctgatgcagcatcaggcccagtattaccctaacgtgatcaatgaggctttgattagtaggctccacgatgtcatctttttccaacggaaactgaaggagcaggaacgcgggttttgcacctactatccatctgagagaaggacgttccgttgtatgccctcctttcagcaataccggatggttcaggagttaaacgccctggaatgggtggacgcagctggaaagcattgcctccgagactatcctgagagcagagatcttattctgtcggaattggagaatatctctactaaagccggtgagttcaccttcggcaacatgaagaaaatactaaagaaaatgggggtaattgacggagaagtgtcctttaatttcgagggcccaaagaggaagggttttcaggggaacgtcacatcacgcgaaatgcggcacgaggattgtttcggaactagatgggacgaactgagtctcgatgagaaagacgatatcattgacaagatcaatgatgaccacctggatgacgaggacatggaaaggtaccttatcgatacctatggcctgagctccttttctgtgggcaacgcgattaatgcccgcttgctcgaggggacagcaaacgttagccgaaaagctgcccggaccctgtacgaaacgatgttatcagctaattgcctgcagagtgacgccgtgatagcagtctccgagcaagatgacactttcgtgaacccgtatagccgtacaggaagaggtgaactactctctgagctgccctactacggcgaggcctttcaggatgggaggcatatcattcctggaaagcgcgaaccaaaagtatcacacgaccagcttaagttctatggcggtgttagtaaccccaccgtgcatatcgctttgaatcagatacggctggtcgtgaacgagattatcaagagatacgggctccctagctccatctctattgaactggcgaggaatcttccagagggccaagatggacgacgcaaaatcgaaaagatgcagtcggagaaccagaaaaataacgagcggtatgaccagattctgactgaaaatggccaaagccccaacagagataataggttgcgtctcgcactgtgggaggaattaggggagggaccgacagaccgcctgtgtgtctttaccggtaagctaatagaactcgccgatctgttcaacggctccgtggagatcgagcaccttattcctttttcagttagtttggacgattctaaagctaataagacggtgtgctggaaggaagccaaccggttcaaagggaataagaccccctacgaggcatttgccaacaatagcggagactattcctgggaagagatcatggagagagtaagggctctgccaaactcaaaacagtggcgattccaggaagacgccctcaagatctggaacagcgatcactctgacttctccggccggcatctgaatgatacacgctacattagtagattagcaagggagtatctggaaaacatatgtccttttaataaaatcgacgtcgtgactggtcggcttaccgcgttgctccgagggcactggggcctgaacaatattctaagaggacataacgagcccgaaacagctactccaaagaaaatgcgcgatgaccacaggcatcacgccatcgatgcagttgtgattgccatgaccagcctgacaatcctccagaaggtctcttccgctgccggcaaggcagaggagctggacgtggggaaacttttcgctaaggatgaatcaggacgtagtgtaatagacccctgggatggttttcgggacgaggtggccgaaaaagttagaaatatcattgtcagccacaagaccaaaaggaagactatcggcaactcggggaagtccacggatcgcgcgttgcataatgagacagcctacggactgattgacggccctgacgaaaaaggtttatactctgtggtgaccactaagccaatcagctatttcgataaccgagacaaaatagagaagattagagatgagaaactccgggacgattttctgaccgcttgggacggggaaggcgataataaggcatcacaacttgccgtcctggacaaggctagtggattgaacgttaaaaagtgcaggtacgtggagcgcaaaaaggtgatcccgattaatggccccgatgggcagccttataaagcctacgacggaaactccaattggggcatggaaatctatgagttcccaaacggtcaccccaaggaaaagaaatggaacggggtagtcatatctacatacgatgcaaataagagcgagtttaaacctggagagaccttccgtccacatcccgcggccaagctcgtgatgagactgcacatcaacgacattgttgaagtgcagaatgacggcgagccgatcctatatcgggtccaactgatttccgctggtactctcacagtgtcacctctgcacgaagccaacgttgatagcaggaatcgcgacaaacatgatgagtttaagtacaaaagtctttctgtgacgccaatgcagaagatgggcgcaaagaaagtaaacatctcccccaccgggttgaagaattacagccgatga

SEQ ID NO: 2767 - RNA, 3345 nt, synthetic construct
  misc_feature 1..3345: note = Cas9 variant
  source 1..3345: mol_type = other RNA
atgggcatcattatagggctggacatcggaattgccagcgtgggtatcgctgtcgttgataaggacaccctcgatattaaatgcgtggtatccgaccttttcgattctgcagacgcctcaaagaacatcgagagaaggaataaccggcaggcgcgccgactgaatcgtagaaggaaaacacggataggcgattttaacactttgtgggtgagtatgttcggggaattacccgaggaagtcgacagcaatgtgctgctactccgcaacgctggactggatgagcaacttacgctggacgaaatctactgtgttttgaagtatatgctcaaacacagaggcatttcctacctggaggatgccctgaatgaggaaaacgtgaccggttcttatcagaaggggatcgcaattaatcagagggagtcggaatacatgctcccttgcgagatccagttagagcggtttcgcaagtatggacaataccgaggcgaatgtgaggccgaaaacgagaatggcgagaaaataacactgtcaaacgtcttcatgactaatagctatagaaaggagattgacaaatttcttaacacccaggggaagtacggaatcttgaatcagaaattcattgatgagtacctgaagatctttaacaggaagcggaaatattacgaaggtccaggcaacgagaagagtcgtacagactatgggaaatacaccactggaaaggacctagatggcaaatatatcacagaaaagaatattttcgagaaactcataggtaagtgctccgtgtacaaggaagaactgcgcgctgcaggggcctcttataccgctcaggagtttaacatccttaatgacctgaacaatattacggtaaacaataaaaagttgactacccaacagaaaaaggatgttatcgaaatagtgcagaacagcgacagaattaatatggagaaaatcatctcctcatgtattggagaaaagatcgagaagattgaaggcgccaggatagataaaaacgagaagaatatctaccatacattcgagcagtacaacaaaatgcggaagatttttgcggagaaaaattatgacatcaaggaactcactatcgaacaactggatgagattggccgaatattaaccatcaacacagagcgcgaagggattaaggacgcaatcatggagagtgaactgctccaccttaataacgagcagattaacctgttgatcgaactaagatacaaaaatagctctctgttcaccaagtggcagtccctctcaataaaagccatgagggagatcattccggatctgtatgaccggaacgtcaatcaaatgaacatccttgctgagcgcggagtgtttaaggataaaattaatctgttcgaaaacagcgtgtacttgcccaaggagcctgtcctcgaagagatctataatccagttgtgagaaggagtatatctatgacgattgacgccctgaacgcattaatcaagaaatacggttatcccgaagacattgtaatcgagatgcctcgtgatcggaatgacgctgagcagaaggatcgaataaagaagttccagaaaactagagaaaacgagctgaagaatatcaaaaagaagattaaagaagagtacggcatcgaaattacagacgagtactttaggaagcataaagggctagagctcgaactgaaactttgggtggagcagaacgaaaaatgcccatattccggaaagtacatcaatgtccaagatatattgtatcaccatgagctgttcgagattgaccacatcatccccctcagcatttcgtacgatgactctcgcaacaataaggtgctggtttataaagaagagaaccaggataagggcaaccggacccctcttatgtacctgtccactgtgaatagacagtatgaccagcacgaatttatgaactacgtcttgtcaacaaaaaccctcccaaggaagaaacgcgagctgttactgaattacgaagatatcacgaagattgacgtgctaaagggtttcataaaccgaaatctcaacgatacccggtatgccagtcgtagcgtactgaatgcgatccaattgtttttcgggggcaaagagtgtgacacaaaggttagagtgattaggggagccgtcactaaccagcttcgcatcaaactgaatctcccgaaggaccgggagaaatcctactctcatcacgcaattgatgctgccatcatgtgctatagccagatgggcctgatgaactttagaaatatacagaacaagttcatcgactttgaaaatgagacctacttatcagatgaaagggacagttgtttcgataacaagtattacgacgaggctctgtttgggcaagtgcttaaaatgcgaaagaatttgctcaaagccgaaggaaagccccagcgctccgtccagagcaaaggtgtgttcgatgaggaggaaaagaacaacggcattgttcggtatcatcacaaagtggacaagaagcctaatagagggctgtctaacgcatcaatctacggaacaaggaaaattgatgacaagatctacaaaatagtaggctatgatattcgtaataacaaggacgccgaggctatcatcaatattatcaaaaagggtaagagtgataactttctaatggcgaaacacgacccagaaactttcaagaatctgatggagatatacgaacagtataaagaggagaagaaccccttcctcgcatacgaacaagagaccggggactatattcgcaaatacgccaagaatcataacggccctatcattaagaaaatcaagtatgtcgatagcgaagtgggatcctgcatagacatctctgctaattacggctacaaaaacggggataagcgggttattatggacacactgaccccatatagagccgatgtgtactataattacaaagacggaacttataggatcattggtgtcaagtacgcagattttaagtattcgaacgccaaatacgtgcttgacgaggaggcttacgccttgatcctgataaaggaaggcttactcaaaattggggatagcctggagaatatctcctcaagtggatatgaataccgactttctttctataagaacgacatcattgagtacacgaaaaatgatatcgtatataaggaacggtttctgagccgcacaatgcccaaggtgaaaaactacatagagaccaagccgatttccgcagcgttgtatgagaaaagaaaccctatcggcctcactaatgctaccaacatttgtaagatctacacagacgttctgggtaatgaaaccaaaatatacaaggagaaattcaagctatcagtcgactga

SEQ ID NO: 2768 - RNA, 3345 nt, synthetic construct
  misc_feature 1..3345: note = Cas9 variant
  source 1..3345: mol_type = other RNA
atgaactacaccgagaaggaaaaactgttcatgaagtatatcctcgcccttgacattggcatagctagcgtggggtgggcaatcctggataaagagtccgaaacagtcattgaggccggatctaatatctttcccgaagcgtcagctgccgacaaccagttgagaagggatatgcggggtgcaaagcgcaataaccgacgtttaaaaactagaattaatgacttcatcaagctgtgggagaacaataacctaagtatacctcaatttaagagcacggagatcgttggcctcaaagtgagggccattaccgaagagatcacactggatgaactttacctgattttgtattcctacctcaagcaccgggggatctcttatctggaggacgctctggatgacactgtatcgggatcaagcgcatacgccaatggcctcaaattaaacgctaaggagctggaaacccattatccatgcgagatacagcaggaacgccttaatacaattggtaaatacagagggcagagtcaaatcattaacgagaatggagaagtgttggatctgtccaacgtcttcaccatcggcgcctacaggaaggagatccagcgggtgtttgagattcagaagaaatatcacccggaactaactgacgagttctgtgatggctacatgctcatatttaatcgcaagcgaaaatattacgaagggcccggaaacgagaagtctagaacagactatggtaggttcaccacgaaactggatgcgaacggcaattacatcactgaagacaacatttttgagaaacttatcgggaagtgcagcgtttatcctgacgagctgcgggcagccgctgcctcctacaccgcacaggaatacaatgtgttgaacgatctcaataacctgacaataaatggacgtaagttagaggaaaacgagaagcatgaaattgtcgagcgcatcaaatcaagtaatactatcaacatgagaaagattatcagcgactgtatgggcgagaatattgatgacttcgctggtgccaggatagataaatctgggaaggaaatctttcacaaattcgaggtgtataacaagatgcggaaggcgctgctcgaaattggaatcgacatctccaattactcacgagaggagcttgatgaaattggctatataatgaccatcaacacagacaaagaggccatgatggaagcatttcaaaagagctggattgatctgagtgacgatgtaaaacagtgcttgatcaatatgcgcaagaccaacggcgctctattcaacaaatggcagtctttctccctgaagattatgaatgagctcatcccagaaatgtacgcccagcccaaggagcaaatgacgctgcttactgagatgggggttacaaaaggaacccaggaagagtttgctggtctgaagtatatacctgtggacgtcgtgagcgaagacatcttcaacccagtggtcagaaggtcggttcggatttcttttaaaatcttgaatgccgtgctcaagaaatacaaggcactggatactattgtaatcgagatgccccgcgacagaaactccgaggaacagaagaaaaggataaatgattcacaaaagttaaacgagaaagaaatggagtatattgaaaagaaactggccgtgacatacggcatcaagctaagtcctagcgacttctcctctcagaaacagctcagcctgaaacttaagttgtggaatgagcaggatgggatttgtctgtactcaggaaagaccatcgacccaaacgatataatcaataacccgcaactctttgaaattgaccatatcattccccgtagtatctccttcgatgacgctcggagcaataaggtcctggtgtatcgatctgagaaccagaaaaagggcaatcagacgccttactattaccttacccactcacacagtgagtggagctttgaacagtataaagcgacagttatgaacctgtccaagaagaaagagtacgcaatatctagaaagaaaattcaaaatttgctctattcggaagatatcactaagatggacgtgctgaaaggtttcatcaacaggaacattaatgataccagctacgcctcccgcttagtcctgaacacaatccagaactttttcatggctaatgaggccgacactaaggtgaaggtaattaaagggtcatacacccatcagatgcggtgcaatctaaagctcgacaaaaacagagatgagagttattctcaccatgcagttgacgccatgctgataggctacagcgaacttggatatgaggcttaccacaagttgcagggcgaatttatcgatttcgagacaggggaaattctgaggaaagacatgtgggatgagaatatgtccgacgaggtgtatgccgattacctctatggaaagaagtgggcaaacatccgcaatgaagtcgtgaaagcggagaagaacgtcaaatactggcactacgtgatgcgaaagtcaaatcggggtctgtgtaaccaaaccattcgtggcactagagaatatgacgggaaacagtacaagatcaataaattagatataaggacgaaggagggaatcaaggtttttgctaaactggccttcagcaagaaagactctgatcgcgaacggcttttggtgtatctcaacgacagaaggacattcgatgacctgtgcaagatttacgaggactattccgatgcagccaatccatttgtacagtacgagaaagaaaccggcgacatcattcgaaagtatagtaagaaacataacggtccccgcatcgataagctaaaatacaaggacggggaggtcggcgcttgtatagatattagccacaaatacggattcgaaaagggctctaagaaagtgatcctggagtccctcgttccttatcggatggacgtgtactataaggaagagaaccattcatactatctggtcggggtgaaacagagtgatatcaagtttgagaaaggaagaaatgtaattgacgaagaggcctacgcaaggatacttgtgaacgaaaagatgatccaaccaggtcagagccgtgctgatttggagaatctgggcttcaagtttaaattatcgttctataagaacgacattatcgagtacgaaaaagatgggaagatttacactgagcgcctcgtttcccggaccatgcccaaacagagaaattatatcgaaacaaagccgatagacaaggccaaatttgagaagcaaaacctggtcggacttggcaaaaccaagttcatcaaaaagtacaggtatgacattctgggtaataaatactcttgcagcgaagagaagtttacttcattctgttga

SEQ ID NO: 2769 - RNA, 3348 nt, synthetic construct
  misc_feature 1..3348: note = Cas9 variant
  source 1..3348: mol_type = other RNA
atgagcgccacctacacaatcggcctggacattgggatagcttccgtgggatggtgcgcattcggtgagactcacatcctcgatcttggcgtcagagcctttgacaaggcggaaacggctaaagagggggaatctctgaacttggccaggcggaatgcacgcttaatgcgacgtagactgttcaggcggacctggcgcctaaagaaactcgccagacagctgaagtcagagggacttattgctgatacaaaactgtttaagcccgaattgcctttcagtaagagcctctggcaactgagggttgacggcctggatcggcgcctcaacgacgaggagtgggcacgagtgatctatcatttatgtaaacacagaggttttcattggatttccagggccgaagctaagcaggccgagggggattctaaatcggaaggaggcaaggtaaaacagggcctggcggggactgcaaaacttatggacgagaagggataccggtcagccgctgagatggtgttggccgagttcccacaggcacaacgtaataagcagggtgagtatcagaaggctctgagccgcgaactactcgccaaagagctggcgcttctgtttgcccagcaaagagaatacggcaacttgcacaccccgggggcactcgagacagctatcctgggaaatggcgataagaaaagtggtttattctggcagcagaagcccgccctggctgggaccgacctccttaaaatgctgggaacttgcacatttgagaagggcgaatatagggcccctaaggcatccttcaccgccgagcggcatgtctggttgacgcgactaaacaatctgcgcatagtgactgatggcgttaccagacagctcacagaacaagagaggcagctgtgtcttccactgccctaccggcaggctggggacttgacttataaacaactcggatctgcgctggcaaaggccggtttactggaagctggcgggtttaaattcaccggactagcctaccctacagaggcacagaaggccgagggcaaagctaaggatccagaaagcgccaccctcgtgaagatccccgcatggcacgagctgcgccagacgcttactaaaggtgggttgaacgacgaatgggagaagctggcgggcgacgctctctgcggacagcctgaaatttttgataaaatcgcctgggtcctgtccgtgtacaaggacgatgacgaggtaagagcagagcttgccaaactggctttgccaaatccgcaagccctcacagaagcactgttaaacattaggttcgataagttccactcactgagtctaaaggctctccgtgccatcgttccccatatggagcagggcctgcggtatgacgaagcgtgtgtgcaggccgggtaccaccatagccagcttttgaaagtcggagagggtgagcacaagtatctgcctccactctacgatggccgagacggggatggaagaatgatatttgctgaagacgcagatattcccaggaatcctgtggtgctgcgctctttaaaccaagcccggaaagtcgttaatgctatcattagaaggtatggctccccatcagccgtgcacatcgagatggcacgcgacctgagccgacccttcgacgaacggaacaagatcaaaaaggatcaggacgagtaccaggcgcgtaatcagagagatagggaacaatttagtgagcttttcggtcatccgcctaaggggttggagtttgaaaaatggcgcctctatcgggagcagaacggccagtgcgcctactctcagagacccctgaccgcttccggaaacgtagccgaaattttcctagacggcagcactgagatagatcacgcactgccatactcgaggtcttttgacgattccaagaataacaaagtgctcgtcctgacacgagaaaatcgcgacaaggggaaccggaccccttatgagtaccttggaggtgctgaaaattcagaaagttggcaaagattcgtgagctttgttgagtccaacaaagcctataggttggcaaagcgtacgcgcctgttacggaaagatttcggcgccaaggaatctgaggaatttagagagaggaatctcaacgacacccgatacgtgtgtcggttctttaagaattatgtcgagcagcatctgaaacttgctgaagggagcgagacaaagcgctgcgtggtagtttcaggacagctgactaacttcttgagagcgaggtggggcctcctgaaagtgcggagtgattccgaccgacaccatgccctagatgcagctgtcgtggccgcctgtagccactctatggtccaaagactgtcaaattacagtcgcaccagggaactcgaacaggtgcgtgacggtttcgttgacatcgagacaggggagattgtgaaccccgctatgcaccagcagctgcgggagcattttccagatccctggccttatttcagacacgaacttgaggcaaggttgaagatcgacagcccagaactgttacgcgaggagatggcccgactcggctcctactctgaagaggaactgaaagtacttaagccgctgtttgtctcgagagcgccccaacggaggaatggaggcgctgcccataaggatactatatacgggcagcctgagaaactaaagaaaaacggaagcgtgacccagaaggttgcactcacatccctgaccttgaaagacattgatctgttagccgacccacaccgcaatgctaagctctatggcgcaatccgtgaaagactggaggcccacggtgggaagggagataaagcgttccccgctactaaccctcttcggaagccagacaaagagggcaaccccacgggtccgatcgtgaggacagtcaccaaggtgattgataaactgtcaggcatccctgtacgcgggggaattgccaagaatgacactatgttgcgagtggatgtttttaccaagggcgggaaattccatctcgtcccagtgtacgtgcaccatagagtcacaggactgcccaaccgggcaataatcgcctttaaggacgaagatgagtggaccctaattgacgacagtttcgattggtgcttttctctgtatcctaatgaccttctcaggatcaaactgaagaaagaaagccactccggctactattcaagctgtaaccgctctactggtgctgttaatttgtgggcccatgatagaaacgtgaatgtggggaaggacggattcatcgagtccattggcgtaaaaatggcagtcagtatagaaaagctgcacgtggatacattaggtaacatctaccccgctccacctgagaagaggcggggcctcgcctga

SEQ ID NO: 2770 - RNA, 3351 nt, synthetic construct
  misc_feature 1..3351: note = Cas9 variant
  source 1..3351: mol_type = other RNA
atgagccagaaccagaatcccaacacccagtcccacctgaatcctacaactcagtcttcaacgcagagtaacccacaaccgaccacacaggagagcctcaagatccttggcttcgacattggggtggcctccataggatgggcttttgtcgaaggtggcgagctgaaagattgcggggttagaatcttcactaaggcagaaaatcccaaagacggatcttcgttggccttacctaggcgggaggcgcgcggcgtgcgacgtagactggctaggcggaagggtcgcctaaacgccctcaaagtactgatttgtaaggaatttgggcttaatagatcagattacctggcaaccgccggagagttgccaaaggcttatgcaacaagcaaagagaccaagagtccctaccagctcagggccgaatccctggagcggaaactgtctgctgacgagttcgcccgcgtgatcctccatattgcgaagcaccgaggctatggcaacaaacatgcaaaggaaagctccgatgacgattcagggaaggtcaaaaaggccatcagtgagaatcagaaagtgatgagcgaaaagggatacactacagctggtcaatatttatacggcgagttttatcagaaagccagaaacttctctgaagcagagcctaagtcccccaaaaatgctagggggacccaggaatttaagaacgttcggaataagtcagagaactacgcccgttgcctggcgcagagcgagcttcaaaaagaattggagataatcttcgccaagcagcgcgaatttggattccagtttagtgacaaaaagcacaaaacgattaatgcaaacggcaagctgaaggagctagatttcgctgacgccgtgctcgaaatcgcttttctgcaaagaccacttaaatctttcgccgataaggtcggtaaatgtactttctacgaggacaagcctagggcaccaaaagattccctgagcgccattgagtttgtggctttgacccggatcataaacacactcgcgaatattactaagcgatcgggggaagtatattctgcagacaaggttcgcgagatcctgtccattgtgttagacaaaggagaaatcacctacaagaacctgagaaaagtcatcgccctcgatgagaggcttcagttcccgaaggactcaaaactggattatgctaaggaagacgccgagaaggcaaaagccattgagtttagtaagttgaaggctttccggaaggccctaggcggcagctttgaagggttcatacgcgcagagctggattccatcgcgacagacattgctctcatcaaatctaaggatgaactgaaagccaaacttgcaaattaccagagcctgaacgacgagcagagagagaagttgtcagaactcagttttgataaattcatagacctgtcctttaaggccttagaggctattctgcccctaatgaggggagataaagacgacaagatctatcgttacgatgaagcctggcgggaggcaggtctcgtggaagtggctaaaaagacccaaaagggcgacagcctgcctccacttatcgagtatgagaaagatttggccaatcccgtcgttgcgcgagccctggctgaatacagaaaggtgctcaacgcactgcttaaaaagcatgggaaagtacacaagattcacctggagttcacgaggcaggccggagtgtcttcaaaggaacgcggcgagatcattgctgaacagaataaacggttgaaggccaacgaggaggcaagaaaaaggtgcgaagagtacggtctcatacctagtgggaagaatatcctgaaattaaagctgtggcaggaacaaggcgagttttgtgtctatagcggaaagaaaattactcagtccgacctacgcgatgaatctacactccagatcgaccatatctacccatattcgcgaagctacgatgactcccagaacaataaggtgctggttttcaccgatgcgaaccaaaataaacttaaccagactccctatgaggcctttggcaaggacatttcaaaatggaatcagatattggggcggatcgagaagctgccgaaagctaagaagaaccgtattacaaacaaaaatttcgccaacaaggaagcaggattcatcgctagaaatattgtggataccagttacatcgccaggctctctgcaagctatacggacgcctttatagagttctgccctctggctgaaaacgaggataccacattaggtcgcggcgagaaagggtccaagaaacacatctcagtcgtgaatggaagcctgactgcgaccatgcggcattactggggccttaacacattgctcgacggtgaaaattctgagtccaaggacagaagtaaccatctgcaccacgccctagatgcaattatcattgcttacgtaaatgacagcgttatcaaggccttttctgatttcaaaaagactcaggaacaaaacaaagccaggctgatagctaaggagattgaatccgcagagtataaaatctcacgacgctttttcagtcccagcgggtttgagaataacgaagccttccggcaggcgattaagagaaagatcctcggccagtcgctggagtccagggaaaatgacatgaccataaactctgaggctcttggagaaaaagtgggcgggatctttgtcagcaagccacctcgtaaacgcgcccggggagcattgcacaaggagacattctcaagtattgatgacaaagatctgttaaagacctacggtggcaaggagggggtgaatagagccatcaaactcggaaaggtcaggcaaattggctccaaaatcgctgacaacggtactatggtgcgagttgatatatttcggcataaggtgtctgggaaattctatggcgtacccatttacacgatggactttgcactgggaatccttccaaacaaggccgtcgtgggcgggaaggataaaagcggagttatcaaggactggctgcccatggattccaattatgagttctgtttctcattgtttaaagacgacctcattctggtgcagaagaaagaaatgagcaaggcggaactatgctacttcgctggctttgatacaagtggtgggcagatcaaagtcgagaagcacgacaaccatttcgccaccctgactgataatcagcgcctcctgtttaacattgcaacccctaaggaagtggccggaaaatctataggcatccaaaatcttaaggtattcgagaaatggcaagtgtccccattgggtgaggttagcaaggctgaatttaaagagagagaaccgattgccctgaagtcgacacccaagaggttcttacagggctga

SEQ ID NO: 2771 - RNA, 3354 nt, synthetic construct
  misc_feature 1..3354: note = Cas9 variant
  source 1..3354: mol_type = other RNA
atgaagcacatcctgggcctcgaccttgggagcaactccattggatgggccttcgtgcagcaagattttgagaataaacagggtaagataatcgctaccggctctagaattatccccatggaccaggggattctgggagatttcgaaaggggcaacacagtctcacagactgcagagcggacgacctaccgcagtatgcgacgtttgagagaaaggcatttactgcggcgcgagagactacacagggttctccatctgcttggttttctgcctccacactatgacgcccaaatcgatttcacaaaacggtacgggaagtttatagacaatgcggaaccgaaaatcgcttataacaatggaaacttcatttttatgaatagcttcaacgagatggtggaggattttaagaagcatcagccccagttgttctacaaaaagtccaatggcgaagagtctcgcatcccttatgactggactatttactatctccgaaagaaggccctgtcgcagaaaatcacccaacaggaactggcatggctcatattacactttaaccagaagagaggctactaccagctgagaggggaggaggaaacagagaatccaaacaaggaagtagccttccactcacttaaagtggtcgatgtggaggctgaagcacccaataagaaaggagagatttggtataccatccggttggagaacggttggatttaccgtcgcactagcaagaatcctctggacgattggaaaggcaagacaagagactttatcgttaccacggatctaaacgacgacgggactatcaaactcgataaggaaggaaaggagaaaaggagtttccgggccccagacgaaaacgattggaatctgcttaagaaaaagaccgagcatgacattgatttctccggcaaacccgtgggtacatatatatacgaccacctgttgcaaaaccctaatcagaagatcaaggggaaactcgtccgaactattgaacgcaagtattacaaagatgagctgaaggctatcttagccaaacagatagcgctgcaaccagagctctttaccgaaacacttctggcagactgcattagagagttgtataggaagaacgaaacccagcagcagaatctactgtctaaggatttcctccatctgtttgtggaggacatcatcttctaccaacggccgctttgtagcaaaaagtccacgattgccaactgcactctggaaaaacgctcatacatcgataaggagacaaatgagagaaaagacgctcccattaaggtatgtgccaagagtaacccttattaccaggaatttagggttttgcagtggctccagaatctgcgtatatatgagatcgaaaccgaccgggaggtgactgcagagttcattgaaacaccacaagattacgaggctttatttaacttcctgatgagccagaaagaaatcgacaatgagggactactcaagtattttctgttcgccaaaaacccccagatcaaggataaagcggccaagtctgaacttaaaaagtggttgaccacgtaccgatggaattatgtctacgacgcagctgataactcctcaaagaaataccctatgaatgagaccggctatgagctgcagagatacctccaaaaggtggaaggcctgccagccaactttcttacattcgacattacttatcagctgtggcacttgctctacagcgtgaaagataaggtcgagtttgaaaaagctctgaagaagttcgccaaaaagaaacagttagacaagaccagtttcgttgattcttttaaaaacttcaagccctatccgaatgagtacgggtcctttagcgaaaaggcaatcaaaaagctgctacctctcatgaggttcggaaaccactgggactttaatcgcatagatgtgtcgacacagaaacggattgacgatctgatcaacggtgtagccaatgaggacattagaactatcataagggagaaggctgaaaaatatcaacttaactctgagacctgcttccaggacttgcccctgtggctcgcgcagtacgtggtctacaatcgccatgcagaagccacagatatcgagaagtggacctccgtgtcagacctggaggcttatttagaggattttaagcaacacagtctgcgaaacccaattgttgaacaggtggtcactgaaacgcttcgggtggtacgtgacatctggcagcagtacagcggcgggcaagccaatttctttgatgagattcatatcgaattgggaagagagctcaaaaagacagcagaggaaaggaaacagctgtccgacaagaaccaggagaatgaaaacaccaatctacgcattaaaaagctgctcgccgagctgaaagaagatgcttctatacagaacgttcggccttatagccttgtgcaacaggagttgctgaagatctacgaggaaggcgtcttctcaagtactgacgagattgaagaggatatccagaagataaggaaaaaggtggaacccaccccacccgagatccagaggtataaattatggctcgagcaaaagtacaaatccccttatacaggtgaagtcattagcctgaccaaactttttactgaggaatacgagatcgaacacattatcccacagtctcgatactatgacgattcactgagtaataaggtgatatgtgagagcgccgttaacaaattgaagacaaaccagctcgggctggagttcattcaaaatcatcacggcgaaaaagtgcgcatcacggcaaacaaggaggtaaccatctttactgaggaacagtacaaagagttcgtcaagaagcactatgcgaataactccgctaaacagcagaagctactgctcaatgaaattccggagaaaatggtggcccggcaactgaacgacacaagatacatctctaagtgcatttcggaaatacttagcaaaatcgttaggtccgatgagaaggacgaaggagtcaattcaaagaacattatcccctgtaccggcaaaattacaactgcattgaagcaggactgggggctgaatgatgtgtggaacgagttaatcctccctcgtttcgagcgcatgaatcagctgacccagacgcaactttttaccagttataacgaccggctgcagaaaaatctaccaacagtgcccatagaatactctcagggattccagaagaaaagaatcgatcataggcaccatgccatggacgctctcgtaattgcctgcgcaactcgagagcacatcaactatatgaataaccaacacgctctggataagagcaaggacaaaaaggaaaaacagcagtcccggattgatttgcatcctctgtga

SEQ ID NO: 2772 - RNA, 3354 nt, synthetic construct
  misc_feature 1..3354: note = Cas9 variant
  source 1..3354: mol_type = other RNA
atgcagaccaagaacctgctctacacacttggcctggacatcgggattgccagcgtgggatggtgcgtcttgggtgagaatagaataatcgatttaggcgttaggtgtttcgacaaagctgaaactcccgatcgcggggagtccctgaacaaggtgcggcgagacgcacgtctaatgagaaggcggctccgcagaagggcctggcggctgacgaaacttgcgcgcctgttgaagcacgctggactcattgattctacccgaatcgtaagagacaggcatgatggcgccgtgtcaccttggcaactgcgggtcgaaggtctggaccgtaaactcgcaccagaggaatgggcccgcgtgatttatcacatcgttaagcatagagggtttcactggataagtagggctgaggagcggaaggcagaaagcgataaaggagagggcggcaaggtgaaacaggggttatccgccacaaagcagctgatggtcgagaaaaattaccgatctgctgccgaaatggtgcttactgagttcccgggagcgcagcgcaacaagagaggtgaatataccaaggcattgtcgaggatcctgctagccgctgagctcacaaccctgtttgaacggcaacaggagcttggcaatccccatgccgggcctgacctgcagactaaaattttgggaaacggcgatcgcaagtcaggtctcctgtggatgcagaaaccacccttaagcgggagtgcactgctcaagatgcttggaaaatgcacattcgaaagagaggagtacagggctcctaaggcctcctttaccgcggaacgtcacgtatggctgacgaaattgaataacctacgggttctggtggacggcgtcactcgaccactctctgatcccgagagaaggctggcccttagcctgccttatcaacaggcatccgacttcacctacaagcagttgcgcgctgccctctgtaagaatggcctgttaccagactcatttcagttcagtgggctggcttatccgacaggagcccaacagcccgatggtaaagcaaagaaccctgaaaatgaccggctagtgaaactcccagcctggcaggagtttagaaagactctgagggatgctggccttgaaaccgagtgggagagcatcgcggggatggcagccggaggccaacccgacttgctggatcagattggttgggtgctctctgtcttcaaagacggggatgaagttctgcgcgagcttcgaaagatccctctgccaggcggagaaaagatggtgcaggctttgtccggcgtatcatttgacacattccacaacctcagcctgaaagccttacggaagatagtgccccatatggaggcagggctgcgttacgatgaagcctgcctagctgccggataccaccatagtgacctcagaaaagataccgacgagaggtctctgtatcttccgcctttgtactccggtcgcacgactgacggccggatggtctttagagatgacattgatgtgcccaggaatccagttgtgctgcgagcaatcaaccaggcgcgcacagtcgtgaatagcgtagttcggagatatgggtcgccttcttccatgcacattgagatggctagggacctctcacgtccctgggatgaacgcaacaaggtgaaacgggcccaagaggaatacagagacaggaacgagaagctgaagatcgatttcgcagccgagtatggaatcgaaccaaaaagtcgagagttcgaaaagtttttactgtaccgggagcagggcggtaaatgtgcttatagccttaagcccttggacctcgatcgcgtcctgagagacctagggtacgccgaagtggatcacgcactgccttactccaggtctttcgacgatagcaaaaataacaaggtcctcgtgctggctgaggagaatcggaacaagggcaatcgaaccccatatgaataccttgacggaacttcagagagtccgagatggcgcgaatttaaagccttcgttgagacaaacaaggcgtataggttggccaaacgtgctcggctgttaagaaaggacttttccggcaaagggagcgaagagttcagggatcgcaatctcaacgacacccgatacatttctagatttttcaagaattatgtggagcggtttctgaaacttgcagaagagtcagaagagaggacgtgcgtagtcctgagtggacagttgaccgccttcctccgcgctcgttggggtctggccaaggtgagaggcgatagcgaccggcatcacgcactagatgcggccgttatagctgcctgttccaggtctatggtgaagcgcctgtcggactacgcacgaagacatgaactcgagaaagtccggacagggtttgtggatttcgagactggagaaatcgtagacgctggcaagtataggcagattgagcgcgattttcccagcccttggccatacttcagagacgaactgcttaccaggttgaacacagatgaccccgccgagctgcgggagcgtatgcaatccttaggttcataccctccagaagcactcgagactctgcgccccatgttcgtgagtcgagccccgcagagaaggaatgggggcgctgcgcacaaagataccatctatcggcagacagaacgccttaagaaagttggatctgtcacccagaaggtgcctctggccgcactaaacctcagagacctggagaatttggtggacccacataggaacgaaaagctgtacgctgccatacgggcccgattagaggctcacggcgggaaaggagagaaggcatttccccctaataaccccctcagaaaaccagatcgcgacggcaaccctactggtcccattgtcaggacggttacactggtgatcgataagatgagcgggatcccagtgcggggaggcgtagccaaaaatgacaccatgcttcgtgtcgatattttcagatccaagaaggacggtaaatttcacctggtgccgttgtatgttcatcacgcggtggctaagcaactccctactagggccgtcatcgcatacaaagatgaaggcgagtggacccccattaacaatcatgacttcgattttctgttcgccctatatccaaacgacctggtgcgcataacacttaagaaagaacggcactttgggtactatgctggatgcaatcgagcaaccggcgccgtttcaatctgggcgcacgatagaaaccagaggattgggaaggacggattcatcgacggcatcggtgtgaagactgctctcagcgtagagaaatttcatgtcgatacactggggaatgtgtaccccgcccctccagaaacgcgccggggattggcatga

SEQ ID NO: 2773 - RNA, 3357 nt, synthetic construct
  misc_feature 1..3357: note = Cas9 variant
  source 1..3357: mol_type = other RNA
atgggcaccagatacagcttcgacatcgggacaaactccattggatgggccgtgtggaggactggtcgggatcccaagggcatatttggggagaaagacgctcctctggaactccttggagcaggcgtccgcctgttcaaggatggtcgaaatccaaaagacgggcagtctttggccacgatgcgtagaatcccgaggcaagcgcggaagcgcagagataggtttgttttacggcgcgaggctctggtggccgcactaattgaagccggactcatgcccgcttcagagaaagaacgaaaggcactggccgaccttgatccttatcagctgagagctgccggcttggacaaggcgctcgcaccacacgagctgggcagggccatcttccatctgcaccagcggcgtgggtttaaaagtaaccgcaagaccgatagaaaaagcgacgatagggacaagggaaaaattgctacagcctccgcagctctcgccaagaagttcgaggatgaaaatgcgcggacttttggtgagttcttatggcgacgccatagagaccccgacatgaaaaggcaggccgtactgaaggcacacgatcctgctaaaggcaagccagaccttcgggccgctaaattgcgccaacccaccagaatcaggctggaagggcagggagccacagcactatacgagttttatcctacccgtgagatgctctgccatgagttcgatgccctgtgggaagctcaggcgcggcaccacccaatgcttctgactcgagaagcaggcgacaagataagatctatcttgtttaggcagcgcgagctcaaaccgcccctgattggtttatgtacattcgaatacgccgctggggagaaggagtcgcggctgcctaaggccctcccatcagtgcaagcaagagaaatctatgagaggcttggacatattcgcctgagcaccggcagtggcacggatcgacccttgaaatcctctgaacgggacgatctagccactgctctgctccactgcgggctgaccaagatcaaagtcagcaagacaaaaggacttgcctttaagactgagttccgtaaggcactgagattgggtggcgaagtgaggataaacttcgaggagatgggggaagagggactcgttgacctgcgcaccaatcggttactggtgcaggatgaccattacggccctagatggagggcgctatcctggtcaggtaaagatgcttttgtcaagaaactcctggaagccacagacgacgataaacttgtggcacgattgatgaccgaggacgggctgagtgccgtacaggctcgcaacgccgcaagcattccactccccgatggctattctcggctgggaccgacggctaatgccgcgatccttcaggccctgattgactccagagatgaaaacggcttcgttgtgacttacgacaaggctgtcaggcgtgcaggggagcgcttgggaaaggattggcaccactcagacgagcgggatggtgaaatcctcgacgccctgccttactatggcaaggtgttacaaagacatatcctgcccgggatgatggatccagctgacaggaaagatgaggccaagttttacggacgaattatgaatcctagcgtgcacataggcctaaaccagctccggcgcctggtcaatgcacttatcgaaagattcggtcccccagaccagattgttgtggagttggcgagggacctgaaaatgagtgcccgggagaaggaacaagagcagcgaagaaaccgcgataatagggaagctaacgagaaacgtacaaagaagctcgtagaactggggcaggacaataacggcgagaaccgggccagattaaaactgtatgatgagcagcaaagggcaggaaatggcgtggctcattgtccctttacccttgaccctatcgggataactcagttgttctctccagaaattgagatcgaacacgtcctcccgcgctcccgaacactggatgacagcgccgcaaacaaggtgctatgctttagaaccatcaatcggattaaaaggggaaagacgccctgggaggccttccatgctgatcctaaatggccagacatcgcggccaacgcagaaaagctgccccctaataaacgctggcgttttagagaggatgctatggacgttttcgaggcccggacctcgggtaagatggataagacaactctcgaacagatgggcctgaccacagggtttcaggccaggcaccttaacgagactaaacacatgtctcgcttggctaaggcatacctgggaaaaatttgtgacccagatgccgtgtatgtcacccccggcgcgttaacatccctcctgcgaggtaagtgggggcttaattcaatactgagtgacgacaacttgaaagatagaaccgaccatcggcaccatgctatcgatgccattactatcggcgcaatgacgaggagcctcctgctagaactgaatacactcgccggaaaggctgagcaatccgactacgatgacgtggtaggcaaggttccgtggcctttcgataactttcgcgacgcagtgagatctgtcgtggatagggtcgtggttagcaataaaccagaacacgggaagcagggagccctgcacgaggacaccgcgtatggcatcgtgggtgatgaggctgaagccgaggaaattgggaaccttgtacggcgtaaattgctggtcgacttaactcccggagaggtggaccgcatacgagatgcaggcctcagaaaggccatgcaggctgccgttgcaccttcaagggacgctcggggtaaagtgagtgatgccaagggcttcgcggccgcactggacaccttcgctaaggcccaggggatgcgcagaatcagggtcggaaaagaggatatgtccgctgtgacaattcatgaccggcaaaccgataaggcatacaaagccgtagcccccggcgaaaatcaccatgtggacgttgtccagatgcgagatggggcttggaagggatttgcggtgactgtgttcgaggcaaaccagaaagactttagaccacagtgggaacgcgagaaacttggcggtaagctggtcatgaggctacacaagggggatgccgttgaactcgagagctctggagtgcggctggtgaagttcgtacaacagatctggatgaaatcaaatttggtcctgttaacagagcataacgaaggcggtgacctccagaagcgtcaccaagatgctgacgacccttttagatgggatttcgccaacattggcaaactgaaggagagggggtgcgtggcagttaaagtggacgaacttggacgcgtcacgaagcggatcagtaatacctga

SEQ ID NO: 2774 - RNA, 3360 nt, synthetic construct
  misc_feature 1..3360: note = Cas9 variant
  source 1..3360: mol_type = other RNA
atgggctacagaatcgggctggacgtgggaattaccagcacaggttatgccgtcctcaagactgataaaaacggccttccctacaagatactgacgttggactccgttatctatcctagggctgagaatccacagaccggggcatctttagccgaaccgcggcgcattaaacgaggactgcgtagaaggacacggcgcactaagttcagaaaacaaaggacccagcagctatttatccactcaggcctcctgagtaagcccgagattgaacagatccttgcgacacctcaagctaagtacagcgtgtatgagctgcgggtagccggtttggatcgccgactcaccaactccgaactgttcagagtgctgtactttttcatagggcataggggatttaaatctaatcggaaggcagagctcaacccagagaatgaagccgacaaaaagcagatgggccagttactgaactcgatcgaggaaattcgtaaagctatcgcagagaagggctatcgcactgtcggggagctttacttgaaggatcccaaatacaatgaccacaagagaaacaaaggatatattgatggttacctgtcaacacctaataggcagatgctagtggacgaaatcaagcaaatactcgataaacagcgggagctgggcaacgaaaaacttaccgacgagttctatgccacgtacctgttgggggatgaaaatcgagctggaatttttcaggcccagcgcgacttcgatgagggcccaggtgcggggccctatgcaggagaccaaatcaagaagatggttggcaaggacatttttgagcctactgaagatagagccgctaaagccacctacacattccagtattttaacctcctgcagaagatgactagcttaaattaccaaaacaccacaggcgacacctggcatacgctgaatgggctcgataggcaggcaatcatcgacgctgtgttcgccaaagcggagaagccaactaaaacatacaagccgaccgattttggagaacttcggaagctgttgaaactacccgacgatgcccgcttcaacctggtcaactatggtagtctccagactcagaaggagattgaaacagtggagaaaaagaccagattcgtagactttaaagcataccacgatctggttaaggtgcttcctgaggaaatgtggcaatccaggcagctgttggaccatataggcacggctctcaccctgtattctagcgataagcgtcggcgaagatacttcgccgaggaattaaatctgccagctgagctaatcgaaaaactcctgccccttaacttttccaagttcgggcacttgtcaattaaaagtatgcagaatatcataccttatctggagatgggacaggtctacagcgaggccacaactaacaccggctatgactttaggaagaaacaaatttctaaggacacaatccgcgaagagatcactaatccagtggtgcggagagcagtcaccaagacaattaaaatcgttgaacagattataaggcgctacggtaagcccgatgggatcaacattgagctcgcccgagagctgggccggaatttcaaagaacgtggagacatccagaagagacaggataaaaacaggcaaaccaatgacaagatcgctgcggagcttactgaactgggcattccggtgaacgggcagaatataatccgctacaaattgcacaaggagcagaacggagtagatccttatacgggtgaccagattccctttgaacgggcattctccgagggctacgaggtggatcatatcattccatattcaatcagctgggacgatagttacacaaataaggtcctcacctctgccaaatgcaacagagaaaaggggaataggatacctatggtgtatctggctaacaacgagcaacgattaaatgccctgactaacatcgcagacaatattatccgcaactcccggaaaagacagaagctactcaaacagaagctgagcgatgaggaacttaaggactggaaacaaaggaatattaacgatacccgttttatcacacgcgttttgtacaattatttccggcaggccatagaatttaaccccgagctggagaagaaacagagagtgctcccactgaatggagaagtcacctcgaagattaggtctcgatggggcttcttaaaagtgcgggaggacggtgacctgcaccatgctatcgatgccactgtaattgcagcgatcacacccaagtttatacagcaagttacgaagtactcccagcaccaggaagtgaaaaacaatcaggctctttggcacgacgccgagatcaaggatgcagaatacgccgctgaggcccaacgcatggacgcagatttgttcaacaaaattttcaatgggtttcctctcccatggccggagttcctggacgaactactggctagaatctcagataaccccgtcgagatgatgaagagtaggagctggaatacctatactcctattgaaatcgccaaactcaagccagtgtttgtcgtgcggctggcgaaccataagatatccggccccgcccaccttgacacaattcgatctgctaaattgttcgatgagaagggaatcgttctgagcagagtgtcaatcaccaaattaaagattaacaaaaagggccaggtagcaacaggggacggaatctacgatcctgagaatagtaacaatggtgacaaagtcgtgtattccgccattcgccaggctctcgaagcccataacggcagcggggagctggcatttccagatggataccttgaatatgttgaccacggcactaagaagctggtgaggaaagtccgtgtggcgaagaaagtatctttgcccgtgcggctcaagaataaagccgctgccgacaacggttcaatggttagaatagatgtcttcaataccgggaagaagtttgtgttcgtgccgatctacattaaagacacggtcgagcaggttctgcctaacaaggcaatcgctaggggcaaaagtctatggtatcaaattaccgaaagcgatcagttttgtttctccctgtacccaggagacatggtgcatatcgagtctaagacaggcataaaacccaagtactcgaataaggagaacaatactagcgtggtacctatcaaaaacttttatgggtacttcgatggagccgacattgcaaccgcctccatcctcgtccgcgctcacgattcaagttatacagcgcgatctattggcatcgccggtctgcttaagtttgaaaaataccaggtggactatttcgggagataccacaaggttcatgagaaaaagcggcaattgttcgtgaagagggatgaatga

SEQ ID NO: 2775 - RNA, 3360 nt, synthetic construct
  misc_feature 1..3360: note = Cas9 variant
  source 1..3360: mol_type = other RNA
atgaacgacaagaaaaatctgggccccctcaccttcgggtttgatatcggaattgccagcgtgggttgggctgtcctttcccctacaagaatagttgacctgggcgtgaggtgcttcgataaggcagagactgccaaagaaggggagtctttgaacttagcgcggcgctcagctcgactgatgcgtagaaggctacggcgcagagcctggaggctcatcaagctggcacggcttctgaaacacgaaggattgattgccgacacgaagacctttatccagccaagtgctagccatgcatccccgtggcaactccgcaaggatggcctggaccgagccctgtctcccgaggaatgggctagagtactctaccacttatgtaaacataggggtttccactgggtgtcgcgggccgaggcgcgtaaggcagatggggacacaaaaggagagggcggcaaggtcaaacaggggctggcctcaactaccaaacttatgaatgataagagctatcgcacagctgccgaaatggtgttggcagagtttcctagtgctcagagaaacaagaggggagaatacaccaaggccctgtcccgggagctactcgacaatgagctgaaacagcttttcgaacgacaacgcgagtatggtaacccacatgcggatactaatctggaagccaagattagaggctctggggaccacaaaagcggattgttttgggagcagaagcccgcactctccggcaacgatctgttaaaaatgctgggtaagtgcacattcgaaaagcaggagtacagggctcctaaagcctcatttaccgctgagcggcacgtttggctcacgcgccttaataacctgagaatcatagtggacgggaggactcgtccattggccgacgcagaacggaccatggccctaagtctgccctatgagcaggtcggagatttcacatacaagcaactccgagctgcgctggtgaaagcaggccttatgcctgacagctttaagttcgcctctctggcttatccatccgaatttcagaaagccgagggcaaggcaaaggatccggaatcagccgctttgactaaactcgccgcatggcaggagctgagagcgaccttaaagaaagctgacctggagagcgaatggcagcaaatcagttgtgccgcactagaggggcagcccgaaacactcgatgagattgccggagtactgtctgttttcaaggacgatgacgaagtgcttaatgagttgcagaaactgggtctccctggcggggctaagaccgagaacgccctgcttgatatcaggttcgacaagtttcatgcactgtccttgaaagctctccgcaagattgtcccatacatggaacggggactgagatacgatgaggcctgcgaaagggcggagtatcaccatagccaattacacaaagtgggcgagggtaatcgcaagtacctgccccctctatataaatcgcgagacaaggacgggcggatggtgttcaacgatgaactcggcgacatcccacgtaatcccgtcgttctgagatctcttaaccaggccaggaaggtgttgaacgctctgatagcacgctacggatccccgtcaagtgtacacattgagatggcccgggaactcagcaaaccttttgatgagagaatgaaggtgggcaaagaacaggaggcttatagggagcgaaatgaaaaggacaaacagacgttcgtcgccgagtttgggatcgtgggagcagcgaagggtggcgagttcgaaaaatggaagctgtaccgcgaacaacaggggaagtgtgcctattccattcagggaatcgatttaaaccggctgcttgagcccggctacgttgagatcgaccatgctttgccatactctaggagctttgatgactcaaaaagtaataaggtgctcgtcctggccgcagaaaacagaaataaaggtaaccgtactccttatgagtacctagatggggaacacaattccgagcgctggcggcagttcgtgggctttgtagaaagcaacaagctgtatagacaagctaaaaggtctcgactcctgcggaaggacttcggaaaggagcaggccgatgagtttcgcgaaagaaatcttaacgacacaaggtacgtttgccggttctttaaaaatcaggtggagcagttcttgaagctggcagaaggctcagagagtaaacgatgtgtcgtgttaagcgggcaactcaccgccttcctgagagctcgctggggacttattaaggtcagggatgagtccgaccgtcatcacgcgctggacgccgtggttgtggcagcttgcactcatggtatggtaaaacggatgtctgattatgccagaaggaaggaattggaccaggtcgccgagggctttgtggatgttgaaacaggggagataatcaacgctgcaatgttccagcagctccacgaacactttcccgacccatggccccatttccgcgatgaggtgcaaatgcgactgaagattgacgatcctgcccagctaagatcggacctgctccggctgggaaattacgcggaggaagatgtccacgctgtgaggccactttttgtaagccgcgccccgcagcgtagaaactccggcgcagcccataaagagaccatctatggtcaacccgaacggttgaaggctcaagggggcgtgacggagaaagttgcactgaccgccttaacaatgaaggacctcgataggctgatagaccctcaccgcaatgaaaaactttacgcggctattcgaaagagactggaggagttcggaggcaaggccgataaagcatttgccgcttcaaacccactacacaagcccgacaaagaagggaaccctactggaccaatcgtccggaccgtgacactcgagatcgacaagctgagtggcgtgcccgtcaggggtgggattgccaaaaatgatactatgttgcgcgttgacgtgttcaccaaggcaggaaaatttcatctggtgccggtatacgtccaccataaggtgacaggcttacctaacagagctatcgttgcctctaaggatgaagacgagtggaccgcgattgatgacagcttcgaatttctcttctccctgtatccaaatgatcttgtgactataacgcagaaaggtaaggcccccgtcaggggctactatgcatcatgtcaccgggggacaggagcttttagcctgtgggcccatgaccgtgcttcttccgtgggcaaagggggacagatcgagggcattggtatcaagaccgcattggccgttcagaaatacaacgtggatgtactcgggactacctatgccgctcctctggagcagcgccgaggactagcgtga

SEQ ID NO: 2776 - RNA, 3363 nt, synthetic construct
  misc_feature 1..3363: note = Cas9 variant
  source 1..3363: mol_type = other RNA
atgagaaaggtgaccatcggcttcgacattggggtcagctccgttggatggtctgtggtagatatgaacaatggtgccatagtggagacaggcgtcaggctgttttcagctagtagcgcagaaaacaatgtggagcggcgcaacaatcgacagactcgtagactcaacaggcggcgcaaaaatagacttaaggacgttaaatacctgttggaaacgaaccacttcacctttgatcaagagcaggggacaaatccctatgaattaagggtggccggactgcatcggaagctaactcgctccgagctcgcgcgagctctgtaccaccttgtcaaaagaaggggcatctcttatgacctgaccgatattgaggaagaggaaatcgtgacaacctcggcctacaagactgcattgggtaagaaccagtcacagctcgccgagaaaacacctggggagattcaattcgctcggctggaaaattatggaaaggtacgtggcagcatcgagataaacgaacaggacatcctgctcaatatttttccaaccagtgcatacttaaacgaggccaaacgcatcctggctacgcagagaaagttctatccggaaattactgaggcctttatcgagaaatactgcaccatacttacaaggaagcgggaatactatgttggccccgggactgagaagaatcgaaccgattacggaatttatcgcacaaacggtgaaaccttggacaacctgttcgagatcctaattggcaaagataagttttaccctaatgaagagagagcggcagggaactcctatacggcccaactcttcaattttgtgaacgacctgaataaccttaaaatccagactatcgaggatcagaagctgacaccaaaacagaaggaagagattatagaacaggtcaaaaccgctgagaagaaggtgtctttgatccaactcattagcaaaatcactaagacacccaaagaccagataaccggatacaggacggataagaatggcaaacctgacctgcattccatggccgtgttccggaaggtccgcaagcagtttttaaccatggaaattgacatcctgcactggccagatgagctccttaacgacctgggtagattgctaacactgaatactgagaaaggggaaatcaggaagcaactcaccaaagatttcatgaagcgttatcccattctgaacgagcagcttgttgaccagatcattgaaaatcggcatatattcgcagtgtcaggaaaccacaaatggcaccgatttagtctgagaacaatgaatgagttgctccctgagatgctggctactagcaaggaacagatgaccttactgtctgagaggggcatgatcaagcaacataaacgcgattacctaaagatgaacgaactcgacgcccggctgatttccgaggaaatctacaatccagtagtgggcaaatcagtcagagaggcgatcaaacttttcaacgagttgatgaaaaagtatcaggaagtgaggtacgttgtgctggagatgccgcgcgatgacaacgaagagaaggccaaaaaggaactccagaaatatcagaaggagaatgagaacgaaaaagagattgcactgagcgaatttcaacgaaaggggttctttagtgatgctcagcttgagcgggccctgataaaagaccgtaagttgaagacaaaaatcagattctggcaccagcaggaaggaaagtgtctctactctggtcaaattatcacccccgtcgagctgttaactaattcctttagcttcgatattgaccatatcatacctcagtcggtgtcttttgacgattccctgaacaataaagtactatgcacgaaggagatgaacgaccagaaaggcaagcagacaccatatgggttcctcctgaatggaaacggccaaggttttgataggttcaaggctatggttaatgccaaccgccttatgtcaaaagggaagaaaaagaatttgctgtttatggaagacctcaacaatatcgagacccggaaaagattcattgcaaggaacctggtggatactcgatacgccagtcgcgtcgtgttaaatgaaatccagcagtatctgcgggctaagaacaaggacacccaagtcgcggtggttagaggcaaattcacagcaacccttaggaagcactggaacattaataaaagccgtgagactcaccatcaccatgccttggatgcttccatcatagccattacacccctcctgtctgtgtggaagaaaaagcagacgctaatccctaagaccctgagcgaggaaaaactcgagtttgaatacgacgatattgtagaggacactatcttcgaaaaggcactgtaccagcttccaaaagagaactttaaggagcagttgaataactcacaacccaatataaaattcagttatcaggtcgataagaaaatgaaccgcaaggtgtccgacgccacaatctacagcgttaagcaggctaaactgtcttcagataagcagagtgaagagtatgtgttagccaaaattaaggacatctacagcgtcgaaggatataaaacctttgcaaagatttacgagaaggacaaatccaagttcctcatggcgcaaaatgatccgaaaacatttgaaaagctggaggagatcatacagtcttatccttcgactcgggaaattatcgtgggcgagaaagtaaaggtggttgacgtcagccccttcgaactttacagaaaggagtacgggtatatcaccaaatacgctaagaaaaacaatggaccaattatcaggcagctgaagtattacgatcacaaaattggtatgcatttggacataacgaaccagaagaataacggcaaggggaaaaaggtgatcctccaacagctgaaatcctggcgaaccgatgtgtattacaatcacgaaaagcaggagtatgagattatgggactaaaatactcagacctgcggtttaagaaggatcaatacggcatccctaaagaacgctatcaggaggtcaagcagatggaaaagattgcaccccagagtgagttctgtttttctctctacagaaacgacaggatcaaggttctgaataaagagacagatgaagaggtggaacttttgttcggtgcccggaactatactagcgccgggtacgtggacctgaagccaatagatcgagtagagtttggcaaaaaggaatggatccccgtctatcaatacgctacctccgacggaaagtgcaaaaagaaattcgccaagaaaggctatgagatttacaaggtgaacacaactatcttaggggagtcatactatattaagaaagaaagaatgctccctaagaatatcctggattga

SEQ ID NO: 2777 - RNA, 3363 nt, synthetic construct
  misc_feature 1..3363: note = Cas9 variant
  source 1..3363: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggcgcgtgagactgaataggctatttgaggaaattggcctcatcacggacttcaccaagatatcaatcaacctgaatccttaccagcttcgggtcaaaggtctgacagatgagttgagtaacgaagaactctttattgccctgaagaatatggtgaagcaccgcgggatcagctatctggacgatgcgtccgacgatggaaactcttcggttggcgactacgctcagattgtgaaagaaaattcaaagcagctcgaaactaaaaccccaggccaaatccagttagagcgatatcagacatacgggcagctgagaggagatttcaccgtcgaaaaggacggtaaaaagcataggcttataaacgtgtttccgactagcgcctatcggagtgaggcattgcgtattctgcaaacacagcaggagttcaatccccagatcaccgatgaatttattaaccgctacctagagatcctcacgggcaagagaaaatattaccacgggcctggaaatgaaaagtccaggactgactacggccggtatcgaacctctggtgagacactggataacatcttcgggattcttataggaaaatgcactttttacccagacgagttccgcgccgctaaggcaagctataccgcccaagagtttaacctgttgaatgacctcaacaatctgacagtacccaccgagacgaaaaagttatccaaagaacagaagaaccagatcattaattacgttaagaacgagaaagctatgggccctgccaagctgttcaaatatatcgcgaagctcctttcatgtgatgtggcagacataaaaggctacagaattgataagagtgggaaggccgaaatccatacttttgaggcttataggaaaatgaagacactggaaaccttggacatcgagcaaatggatcgggagactctagacaaactggcctacgtcctcacactgaataccgaacgcgagggaatccaggaagcacttgagcacgagttcgctgatggtagcttctctcagaaacaggtggacgagctggtgcaatttagaaaagccaactcctcaattttcggcaaggggtggcacaattttagcgtcaagttgatgatggagctcattccagaactgtacgagacgagtgaagaacagatgaccatattaacaaggctgggaaaacagaagactacctcttccagcaacaaaacaaagtatatcgatgagaaactactcactgaagagatttacaatcccgttgtggcgaagtcggtacgtcaggccatcaagatcgtgaacgcagctattaaagaatatggcgacttcgataatatagtcatcgagatggcccgggaaaccaacgaggacgacgagaagaaagctattcaaaagatccagaaagccaataaggatgaaaaagacgcagccatgctgaaggctgcgaaccagtacaacggtaaggcagagcttcctcattctgtgtttcacgggcataaacagttggccacaaagattcgactgtggcaccaacagggcgaaagatgcctctataccggaaaaactatctccatacacgatctgatcaataacccaaatcagttcgaggttgaccatattcttccgctgtcaatcacgtttgatgacagtttggctaacaaggtgctcgtctacgccacagcaaatcaggaaaaaggccaaaggaccccctatcaggccctggatagcatggacgatgcttggtccttccgcgagttaaaggcctttgtgcgggagtctaagactctgagcaacaaaaagaaagaatacctactcaccgaggaagacatttcaaagttcgatgtaagaaagaagtttatcgagaggaatctggttgacacacgctacgcaagtcgagtggtccttaacgcgttgcaggaacacttccgggctcataagatagataccaaagtgtccgtcgtgcgtgggcaatttactagccagctgagaaggcactggggaattgagaagacacgcgacacgtatcatcaccacgccgttgacgcactcatcattgccgcttcttcacagctgaatttatggaaaaagcagaaaaacaccctggtgagttacagcgaggatcaacttttggacatcgaaactggtgagctcatatccgatgacgaatataaggagtctgtattcaaggccccttaccagcatttcgtcgatacactgaaatcgaaggagtttgaagacagcatcctattctcctatcaggtggattcaaaatttaatcggaagattagtgacgcaaccatctacgctacaagacaggccaaagttggcaaggataaagcggacgagacttatgtgctggggaagattaaggatatctacacccaagacggatacgatgccttcatgaaaatatataagaaagacaagtctaaatttctcatgtacaggcacgacccacagacgttcgaaaaggtcattgagcccatcctggaaaactatcctaataagcagatgaacgagaaaggcaaggaggtgccatgtaatccctttcttaaatacaaggaggagcatggttatatccgaaaatacagcaagaaggggaacggcccggaaattaaatccttgaagtattacgattcaaaactgggaaaccacatcgacattacccctaaggatagcaataacaaagtagtgttacagtctctcaagccctggcgcacagacgtttacttcaataagaacactggcaaatatgagatactggggcttaagtactccgatatgcaatttgaaaaaggaaccggtaagtatagtatcagcaaagagcagtacgagaatattaaggtccgggaaggcgtggacgagaactctgagttcaagtttacactgtataaaaatgatttgctcctgctaaaggactccgaaaacggggaacagatcctgctcagattcacttcaaggaatgataccagtaaacactacgtggagctgaagccatataaccgtcaaaaatttgagggaagcgaataccttattaagtcgttgggcacggtcgttaaaggtgggcgctgcatcaagggcctgggaaagtccaatatatctatctacaaagtgcggacagacgtgttaggcaaccagcatattatcaagaatgagggggataaacctaagctcgacttctga

SEQ ID NO: 2778 - RNA, 3363 nt, synthetic construct
  misc_feature 1..3363: note = Cas9 variant
  source 1..3363: mol_type = other RNA
atgggcctggacatcggggtggccagcgtcggattctccgttctcgatattgacaagggtaaagtgatagagcttggcgctagactgttttctgcaaccgtagccgcggggaaccaggataggcgggacatgcgcggagctcgacgtttgttaaatagaaacaagcaaaggcggcaggatacaggcaaactgttcaagaaatttggtctaatcgacgatttcgacaaggggtcattttacgataatttcaaccagaatctcaacccctatgaactgcgcgtgaagggacttactgagcagctgacgaaagaagagttggccgaaagtctctaccaaattgtcaagcacagaggcatcagctatgcactgaaagacgccgatgtggacgagggcgggaccgattactccgtttctctgaagattaattcgcaggagctcgctgagaaaactcctgcacagatccagttacaaaggctgaacgactatggaaaggtgcggggtcaggtcgtgataggcgacgatccagacaatcagaaggtacttttgaacgtttttccgacatcagcctacgagaaagaagctaagcagatcattgccacccaacagcagttctatcccgagagcctgacagataaatttaccgaggaatactgccaaatcctaactcgcaagcgagactacttcgtggggcctggaaatgagaaaagtagaacagattatggcatttacaagaccgacggtaggacgctcgataacctgtttgaagaacttatcgggcatgacaaaatatatccagaagaactgcgggcgtccgcagcctcttacactgctcagttgttcaatgtcctcaacgatctgaataacttacgtattctgaactatgaggacggaaagctcaccaaggaagataaagagaagatcattgccgaaatcaaaaataacacaactaccatcaatatgcttaacgtgattaagaaagtggcaggctgtagcaaggacgacataaagggctttcgcgtcaatgagaaagataagcccgaaatctcctcaatgcctgtttacagaaaaattcacaaggacctgttgaaagctggggtggatatcagtgactggccagtagagttcatagatgagcttagcttcattctgacactcaacaccgaaaatggagagatcaggaagcagctgaacaatcggcttgcccccaagtttgacttcctgaacgcggatttgatccagctcattatcgacaataaagattcttttgaaattaagacgaacaataaatggcatcgattctccgtgaagactatgaacaaactgatacctgagatgatggaacgcccagtcgagcaaatgacattactgaatgagatgggtctagtgaagaaggacaaaaagagatttgaaaacaacaaatatctcccgtacaaggagatcgccaaagatattttcaatcccgttgcatcaaagagcgtgagggaagctctgaaaatcgtcaacgccgtgcttaagaagtacggccacatcgactatttggtagttgagatgcctcgggataaaaatctgaaggaggaacaggacaacattaaagagtttcagaataagaacaaaaaggctaaggacgccgcattcgaagcctttgtgaaaagtgtcgggtctgagcagcgcgtgaaggaagctctctccaaaaatagaaagctgcaaatgaaaatgaggctttggtaccagcagcaggagatagatccatataacggaaagaccatcgacgcgactgatctgattaataaccccgacaagttcgagatcgatcatattatccctcaaagcatatcgttttacgactctatcaataacaaaacattgtgcttcgcatccatgaatcaggtcaagggccagaaaaccccatatgaatttatgctcgagggtcacgggcagtcatacgataagttcaaagccacggtgatggctaacaagaatttcggcaaggccaaacgtgcaaactatctgtttgaagagaacgttagtgacattgaaacccggaagcgattcttaagcagaaatctggtggatacaaggtactcctctcgcgtagtcctaaacagcctccaagactttttccgggagaaatcagccgatactaaggtgaccgttatcagaggaaaatttacaagtaatatgaggaagcactggcatattgacaaaactcgcgagaccttccaccatcacgctatcgatgcctccataattgcagcgacaccctttctgcgaatgtggaagaagggcgggaccatcttcccggtgaaagtcggagaagagagcattgacatcgaaactggtgagatacttgacgataagaactttgacaaagctatgtacgaggagccttattctggcttcgtgtcagagatcatgaatgccgatgaccggattaagtttagtcaccaggtagataaaaagatgaaccgtaaggtgagcgacgcaacgatctactccacaagaaccgggaaattggccaaggataaaaaggacgctgaatatattgttgccaaagtcaaggatatctactctgtggacggattcaagaaatttaagaaagtgtatgataaggacaaaactaagttcctgctctacaagtatgaccccaggaccttctcgaaactggagcgcataattagcgattgtccagacaaggtcgaaaaagttcagacaaatggcaaggtgaaagcagtggatatctccccttttgagatgtaccggagagaccatggtatgatcaagaagtacagtaaaaaggggaacggccccgctattaaacaattaaagtatctggataaaaagctaggatcacacatcgacattaccccagccaatgcgaacggcaaacatgtaatattgcagtctctcaagccctggaggactgatgtctacctgaatcacgagacaggggaatatgagatcatgggaattaagtacagcgacctaaaattcaacaagaatgaaggttatggcatcaaaaaggataaatacctggagattaagaaggtggaagaggtttccgagaaatcagaatttatgttcagcctctatcgaaaggaccgcgtgaaagtccaggatatgaagacgggggagtctgtggaactgttgttttggtcccggaacttcagtaataaaaagtacgccgagcttaagcctatcagccaggctgaaaacgacaaaaagctgccagtttacggaaaaggcagattaataaagaggctcatcccgaaaaactgcaagatttggaaggtgaataccactatcctgggtgatccctattaccttgagaaagagtctgactcccctaaggacattctggattga

SEQ ID NO: 2779 - RNA, 3366 nt, synthetic construct
  misc_feature 1..3366: note = Cas9 variant
  source 1..3366: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggcgcgtgagactgaataggctatttgaggaatcaggcctcattacggacttcaccaagatcagtataaacctgaatccttaccagcttcgggtcaaaggtctgacagatgagttgagcaacgaagaactctttatcgccctgaagaatatggtgaagcaccgcgggatttcctatctggacgatgcgtctgacgatggaaactcgtcaatcggcgactacgctcagattgttaaagagaatagcaagcagctcgaaactaaaaccccaggccaaatccagttagagcgatatcagacatacgggcagctgagaggagatttcaccgtggaaaaggacggtaaaaagcataggcttataaacgtctttccgacaagtgcctatcggtccgaggcattgcgtattctgcaaactcagcaggagttcaatccccagatcaccgatgaatttgtgaaccgctacctagagattctcacgggcaagagaaaatattaccacgggcctggaaatgaaaagtctaggactgactacggccggtatcgaaccaacggtgagacactggataacatcttcgggatccttattggaaaatgcactttttacccagacgagttccgcgccgctaaggcaagctataccgcccaagagtttaatctgttgaacgacctcaataacctgacagtacccaccgagacgaaaaagttatccaaagaacagaagaatcagataatcaactacgttaagaatgagaaagctatgggccctgccaagctgttcaaatatattgcgaagctcctttcatgtgatgtggcagacatcaaaggctacagaatagataagagtgggaaggccgaaattcatacttttgaggcttataggaaaatgaagacactggaaaccttggacatcgagcaaatggatcgggagactctagacaaactggcctacgtcctcacactgaacaccgaacgcgagggaatccaggaagcacttgagcacgagttcgctgatggtagcttctctcagaaacaggtggacgagctggtgcaatttagaaaagccaattcctcaattttcggcaaggggtggcacaactttagcgtcaagttgatgatggagctcatcccagaactgtacgagacgagtgaagaacagatgaccattttaacaaggctgggaaaacagaagactacctcttccagcaataaaacaaagtatatagatgagaaactactcactgaagagatctacaaccccgttgtggcgaagtcggtacgtcaggccattaagatcgtgaatgcagctatcaaagaatatggcgacttcgataacattgtcatagagatggcccgggaaaccaatgaggacgacgagaagaaagctatccaaaagattcagaaagccaacaaggatgaaaaagacgcagccatgctgaaggctgcgaaccagtacaatggtaaggcagagcttcctcattctgtgtttcacgggcataaacagttggccacaaagatccgactgtggcaccaacagggcgaaagatgcctctataccggaaaaactatttccatccacgatctgataaacaattcaaaccagttcgaggttgaccatatccttccactgagtattacgtttgatgacagcttggctaataaggtgctcgtctacgccacagcaaaccaggaaaaaggccaaaggaccccgtatcaggccctggattccatggacgatgcttggtctttccgcgagttaaaggcctttgtgcgggagagcaagactctgtcaaataaaaagaaagaatacctactcaccgaggaagacatcagtaagttcgatgtaagaaagaagtttattgagaggaacctggttgacacacgctacgcatcccgagtggtccttaatgcgttgcaggaacacttccgggctcataagatcgataccaaagtgagcgtcgtgcgtgggcaatttacttctcagctgagaaggcactggggaatagagaagacacgcgacacgtatcatcaccacgccgttgacgcactcattatcgccgcttcaagtcagctgaacttatggaaaaagcagaaaaataccctggtgagctactccgaggatcaacttttggacattgaaactggtgagctcatctctgatgacgaatataaggagttcgtattcaaggccccctaccagcattttgtcgatacactgaaatcgaaggagttcgaagacagcatactattttcctatcaggtggattcaaaattcaaccggaagatcagtgacgcaaccatttacgctacaagacaggccaaagttggcaaggataaagcggacgagacttatgtgctggggaagatcaaggatatttacacccaagacggatacgatgcctttatgaaaatctataagaaagacaagtctaaattcctcatgtacaggcacgaccctcagacgtttgaaaaggtcatagagccaattctggaaaattatcccaacaagcagatgaatgagaaaggcaaggaggtgccttgtaacccattccttaaatacaaggaggagcatggttatatccgaaaatacagcaagaaggggaacggccccgaaatcaaatccttgaagtattacgattcaaaactgggaaatcacattgacatcaccccgaaggatagcaacaataaagtagtgttacagtctgtttccccttggcgcgctgacgtctactttaacaatacaactggcaagtatgagattctcgggctgaagtacgcagatcttcaattcgaaaaaggaaccggtacatataagataagtcaggagaaatacaacgacatcaagaaaaaggagggcgtggatagcgactctgaatttaagttcactctgtataaaaatgatttgctcctggtgaaggagaccgaaacgaaagagcagcaactatttcggttcctgtccagaacaatgcccaagcagaaacactacgtcgaactcaagccatatgacaaacagaagttcgaagggggagaggccctgattaaggttcttggcaacgtggctaatggtgggcagtgcatcaaaggcttgggaaagtcaaacattagtatctacaaagtgaggaccgatgtactgggcaatcaacatataatcaagaacgaaggggacaaacctaagttagacttttga

SEQ ID NO: 2780 - RNA, 3366 nt, synthetic construct
  misc_feature 1..3366: note = Cas9 variant
  source 1..3366: mol_type = other RNA
atgaacggcctggtgctcgggcttgacatcggaattgccagcgtcggtgttggcatactggagaaaaattccgggaaaatcattcacgctaactctagattgttccccgcagccaccgcggataataacgtggaaaggcggaagaatcgccaggctcgacgtttaaacagaaggaaaaagcatcggggagtacgctttcaagacctgttcgaggattacggcctactcacagacttttcaaaagtgagtatcaatctgaacccttatagacttagggtcgatggtctgaataagcagttgactaacgaagaactcttcattgccctgaagaatatcgtgaaacggcgcgggataagctacctggacgatgcatccgaagacggaggcacggtttcttcggattatggcaaggccgtggaggagaaccgaaaactcttagctgaacagaccccagggcagatccaactggagagatttgaaaagtacggacagcttaggggtgacttcacagtcgtggagaatggcgagaaatgccggttgattaacgtattttcaactagcgcatataagaaggaagccgagcgtatcctgcgcaaacagcaggagttcaatagtaagattaccgatgagtttatcgaagactacctaaaaatactcacagggaagagaaaatattaccacggaccgggcaacgagaagtccaggaccgattacggtcggttccgaaaagacgggactacactggacaacatttttggaatccttattggcaagtgtaccttctatcccaatgagtaccgcgcttctaaggccagctatacggcgcaagaatttaacctgttgaatgatctcaacaatctgtccgttcctactgagaccaaaaagttatcagaggaacagaaaaagacaatcatcgaatacgcaaaaagtgccaagactctgggcgctagcaccctccttaagtatattgccaaaatgatagacacatctgtggatcagatcagagggtacagggtcgacgtgaacaataagccagagatgcataccttcgaggtgtatcggaaaatgcagtccctggaaacgatttcagtcggagagttgagccgcaacgttctagatgaactggcacacatcctcactctgaatacagagagagaaggtatagaggaggctattaacaccaaacttaaggacagtttctctcaagatcaggtgctggaattggtacagtttaggaagaataactccagcctcttctcgaagggctggcataatttttctctgaaattaatgatggagctgatccccgaactatacgagacttccgaggaacaaatgacaatcctcacccgtctggggaagcagaaatcaaaggagacgagtaaacggagcaagtacattgacgaaaaggagcttaccgaagagatctataaccctgtggtcgccaaatccgtgcgacaggcgattaagataatcaatgaggccacaaagaagtacggaattttcgataacatcgttatcgaaatggcaagagagaacgacgaagaggatgctaaaaaggactatattaaaaggcagaaggccaatcaagacgaaaagaacgctgccatggagaaagcagcctttcagtacaatggcaagaaagagttgccagataacatattccacggtcacaaggaactggctactaaaatccgcctctggcatcagcagggggagaagtgcctgtataccggcaagacaattcccatctctgaccttattcacaatcaatacaaatatgaaatcgatcatgtgctgcctttgagcctctcatttgacgatagtctgtccaacaaggtcttagtgctggcgactgcaaatcaggagaaaggacagcggaccccattccaggccctagacagcatggatgacggctggtcttacagagaatttaagtcatacgtaaaagagagtaagctcctggggaacaagaaaaaggagtatcttttgacagaagaggatataagcaaaatcgaagttaagcaaaaattcattgagaggaatctggtggacaaccgctactcctctcgagtcgtgctcaatgctctgcaggatttttataaggcccacaagttcgacaccactatctcggtcgtgcggggacagtttacgagccagttacgtagaaaatggggtctggagaagtccagggaaacataccaccatcacgcagttgatgcccttattatcgctgcctcaagtcaattgcgcctctggaaaaagcataacaatccgctgatatcttataaagagggccggttcattgacagcgaaaccggggagatcatttccctatcagacgatgaatacaaggagctggtgttcaaagcaccctatgaccactttgtagatactctcagaagcaagaccttcgaggactctatcctgttttcctaccaggtcgatagtaagtacaacaggaaaataagcgacgcgacaatctatgctacccgaaaggccaaacttgataaggacaaatctgaagagacttacgtgttgggaaagattaaggatatctattcccaggcaggctacgacgccttcattaaaatctataataaggataaatcaaagtttctgatgtaccataaagaccctcaaacattcgaaaaggttatagaggaaattttacgcacgtatccaagtaaggagctcaacgataaaaacaaggagatcccctgtaatccttttgaaaaataccggcaggagaacggtccaatcagaaagtacagcaaaaaggggaatggccccgaaattaagtcgatgaaatattacgacaagaacatcccggagtccttcattaatataaccccttctaacagcaataacaaagtgctgcttaggcagctgtatccctggcgtactgacgtctactttaatccacagacagataagtatgaattgctcggactgaaatacgctgacctacaattcgagaaggccaccggcaagtattcaatcacaattgataaatacaacgagatcaaggaaaaagagggggtgagtaaggaatccgagtttaaattcactctgtacaagaatgacctcctgcttattaaagataccaagaacaatgaggaacagatctttcgcttcttgtctcggacgatgcctaaccagaatcactatgtagagctgaagccctacgacaaaggaaacttcgaaggtaaggagaaaataaaggtgtttaaaatgaccagcaacggcagatgcatcaaggggttaggaaagaaatatctctccatttacaaggttaaaacagatatcctgggcaataagcacttcattaaaaaggaaggtgacgagccaaaacttaagttttga

SEQ ID NO: 2781 - RNA, 3366 nt, synthetic construct
  misc_feature 1..3366: note = Cas9 variant
  source 1..3366: mol_type = other RNA
atgaacggcctggtgctcgggcttgacatcggaattgccagcgtcggtgttggcatactggagaaaaattccgggaaaatcattcacgctaactctagattgttccccgcagccaccgcggataataacgtggaaaggcggaagaatcgccaggctcgacgtttaaacagaaggaaaaagcatcggggagtacgctttcaagacctgttcgaggattacggcctactcacagacttttcaaaagtgagtatcaatctgaacccttatagacttagggtcgatggtctgaatcagcagttgactaacgaagaactcttcattgccctgaagaatatcgtgaagcggcgcgggataagctacctggacgatgcatccgaagacggaggcgccgtttcttcggattatggcaaagctgtggaggagaaccgaaagctcttagcagaacagacgccagggcaaatccagctggagagatttgaaaaatacggacaggtcaggggtgacttcaccgtggtagagaatggcgagaagcggcgtcttattaacgttttctcaacaagcgcctatcgcaaagaagctgagaagatcttgagaaagcagcaagaatttaataaccagattactgatgagtttatcgaagactacctgaaaatactaaccgggaagaggaaatattaccacggaccgggcaacgagaagagtcggacagattacggtcgattccgcaccgacgggactacactcgacaatatttttggagtgctgatcggcaaatgcaccttctatcccaacgagtacagagcctccaagtctagctatacggcgcaggaatttaatcttctgaacgatttgaataacctcactgtccctaccgagacaaagaagctgtccgaggagcagaagaaagtgattgtggaatacgcaaaggaggccaaaactttaggcgcttcaaccctgctcaagtatatcgtcaaaatgatcgacgccagtgttgatcaaattagcgggtacagggtggacgtaaataacaagccagagatgcatacattcgaagtgtatcggaagatgcagtctcttgagaccatatccgtcggagaactgtcacgcaatgtgttggatgagctagcacacatcctgacgctcaacactgaaagagagggtattgaggaagctatcaatagcaaactgatgggcgttttcagtcaggaccaagtgcttgagctggtccagtttaggaagaacaattcttccttgttcagcaaagggtggcataacttttcgctcaagctgatgatggaattaatacccgagctgtacgagacatctgaggaacagatgaccattctaactcgtctcggaaaacagaagtccaaggaaacatcaaaacggaccaagtacatcgatgagaaagaactgacggaggagatctataatcctgtggtagccaagagtgttcgacaagcgattaaaatcattaacgaagccaccaagaagcacggcatattcgacaacatcgtgattgagatggcaagagaaaataacgaggaagatgctaaaaaggactacatcaaaaggcagaaggccaatcaggatgagaaaaacgctgccatggagaaggcagcctttcagtataatggtaaaaaggaacttccagggaacatcttcaatggccacaaggagttggctacaaaaattcgcctgtggcatcaacagggagaaaagtgtctctacactggcaaaaccatacccatcagcgacctgattcacaaccagtataagtacgagatcgaccatattcttcctctgtccttgtcttttgatgacagcctctcaaataaagtcctggtgcacgcgacagcaaaccaggaaaaggggcaacggactccattccaggccttagatagtatggacgatgcttggtcctatagagagtttaagagctacgtcaaagacctgaagtctctatcaaataaaaagaaagattacctcctgaccgaggaagacatcagtaagatagaggtgaagcagaaattcatcgaaaggaaccttgttgatacacgctatagctcccgagtggtattgaatgccctgcaggacttttacaagtctcaccaattcgataccactatttcggtcgtgcggggacagtttacgagccagctccgtagaaaatggggtctggagaagtccagggagacatatcatcaccatgcagttgacgccttaatcattgctgcctcaagtcaactgcgcctttggaaaaagcagaacaatccgttgatcacctacaaggaaggccagttcatagattctcagactggggagattatcagcctcaccgacgacgaatataaagagctggtgttcaaggcaccctacgatcactttgtcgacacactacattccaaaaccttcgaagatggcattctgttttcatatcaagtggacagcaagtacaaccggaaaatctctgatgcgactatatacgctacaagaaaggccaaactcgacaaggataagtccgaggagacgtatgtactgggaaaaatcaaggacatttacagtcaggcaggttatgatgccttcatcaaaatttacaacaaggacaaaaggaagtttcttatgtatcacaaggatcctcagaccttcgaaaaagtgatcgaggaaatattgcgaacttacccaagcaaggagcgcaatgacaaaaacaaggaagttccctgcaatccttttgagaaatatcggcaggagaacgggccaattagaaagtactctaagaaaggcaatggacccgaaatcaagtgtctgaaatactatgataacaagttaggcaattacatcgacatttccccggacgggtcagataaccaagtcgtgctccagagtctgaaaccttggaggacagacgtgtatttcaatcaccagaccaagaagtacgagcttatgggactgaaatatagcgatttgtcgtttgaaaagggttccggcaaatactctatcagcaacgagaagtataattcaattaaacgtatagaaggggtcaacgagcagagtgagttcaagtttacactctacaagaatgacctgatcctaattaaagattccgaaaacaatgagcaaaagctgttccgctttaactctcggaacgacactgctaaacattacgttgaactcaagccctatgataaagccagattcgacggacagcaggagctgatcaccattcttggcaatgtggcaaagggtgggcaatgcttgaaaggcctgaacaagagcaatatctccatattcaaggtgaaaacggatgtattaggaaagaaacacatcattaagaaagagggcgacgaaccaaagctcaagttttga

SEQ ID NO: 2782 - RNA, 3366 nt, synthetic construct
  misc_feature 1..3366: note = Cas9 variant
  source 1..3366: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggattgtgcgcctgaatagactatttgaggaatcaggcctcatcacggacttcaccaagataagtatcaacctgaatccttaccagcttagggtcaaaggtctgacagatgagttgagcaacgaagaactctttattgccctgaagaatatggtgaagcaccgggggatctcctatctggacgatgcgtctgacgatggaaactcgtcagttggcgactacgctcagattgtgaaagagaatagcaagcagctcgaaactaaaaccccaggccaaatccagttagagcgctatcagacatacgggcagctgcgaggagatttcaccgtcgaaaaggacggtaaaaagcatagacttataaacgtgtttccgacaagtgcctataggtccgaggcattgcggattctgaagactcaacaggagttcaatccccagatcaccgatgaatttattaaccgttacctagagatcctcacgggcaaacgcaagtattaccacgggcctggaaatgaaaaatctagaactgactacggcaggtatcggaccaacggtgagacactggataacatcttcgggattcttataggaaagtgcactttttacccagaagagttccgagccgctaaagcaagctataccgcccaggagtttaatctgttgaacgacctcaataacctgacagtacccaccgaaacgaagaaattatccaaggagcaaaagaatcagatcattaactacgttaaaaatgaaaaggctatgggccctgccaaactgttcaagtatatcgcgaaactcctttcatgtgacgtggcagatataaagggctaccgcattgacaagagtgggaaagccgagatccatacttttgaggcttatagaaagatgaaaacactggagaccttggatatcgagcagatggacagggaaactctagataagctggcctacgtcctcacactgaacaccgagcgggaagggattcaagaggcacttgaacacgagttcgctgacggtagcttctctcagaaacaggtggatgagctggtgcagtttcgcaaggccaattcctcaatcttcggcaaggggtggcacaactttagcgtcaaattgatgatggaactcattccagagctgtacgaaacgagtgaggagcaaatgaccatattaacaagactgggaaagcagaaaactacctcttccagcaataagacaaaatatatcgacgaaaagctactcactgaggaaatttacaaccccgttgtggcgaagtcggtaaggcaggccatcaaaatcgtgaatgcagctattaaggagtatggcgatttcgacaacatagtcatcgaaatggcccgtgagaccaatgaggatgacgagaaaaaggctattcagaaaatccaaaaggccaacaaagacgaaaaggatgcagccatgctgaaggctgcgaaccagtacaatggtaaagcagaacttcctcattctgtgtttcacgggcataagcagttggccacaaaaattcggctgtggcaccagcaaggcgagcgatgcctctataccggaaagactatctccatacacgacctgatcaacaatccaaaccagttcgaagttgatcatattcttccgctgtcaatcacgtttgacgatagtttggctaataaagtgctcgtctacgccacagcaaaccaggagaagggccagagaaccccctatcaagccctggacagcatggatgacgcttggtccttcagggagttaaaggcctttgtgcgcgaatctaaaactctgagcaataagaaaaaggagtacctactcaccgaagaggatatttcaaaattcgacgtacagaagaagtttatcgaacggaacctggttgatacaagatacgcaagtagggtggtccttaatgcgttgcaggagcacttccgcgctcataaaatagacaccaaggtgtccgtcgtgcgagggcaatttactagccagctgcggcgtcactggggaattgagaaaacaagagatacgtatcatcaccacgccgttgacgcactcatcattgccgcttcttcacagctgaacttatggaagaaacagaagaataccctggtgagttacagcgaagaccaacttttggatatcgagactggtgaactcatatccgacgatgagtataaggagtctgtattcaaagccccttaccagcatttcgtcgacacactgaagtcgaaagaatttgaggatagcatcctattctcctatcaggtggactcaaagtttaacaggaaaattagtgatgcaaccatctacgctacacgccaggccaaggttggcaaagacaagaaggatgaaacttatgtgctggggaaaattaaggacatctacacccaagatggatacgacgcgttcatgaaaatatataagaaagataagtctaagtttctcatgtaccggcacgacccacagacgttcgagaaagtcattgaacccatcctggagaattatcctaacaaggagatgaatgaaaaaggcaaggaggtgccatgtaacccctttcttaaatacaaggaggaacatggttatatcagaaagtacagcaaaaaggggaacggcccggaaattaaatccttgaagtattacgactcaaaactgggaaatcacatcgatattacccctaagaacagcaataacaaggtagtgttacagtctgtttccccctggagggccgacgtctacttcaataaaacaactggcaagtatgagatactcgggctgaaatacgctgatcttcagtttgagaagggaaccggtacatataaaatcagtcaagaaaagtacaacgacattaagaaaaaggagggcgtggatagcgactctgagttcaaatttactctgtataagaatgatttgctcctggtgaaagacaccgaaacgaaggaacagcagctattccgatttctgtcccgcacaatgcctaaaaagaagcactacgtcgagctcaaaccatatgataagcaaaaattcgagggaggagaagcactgatcaaggttcttggcaacgtggccaattcaggtcagtgcattaaagggttggctaagagtaacatcagcatatacaaggtgcggaccgacgtactgggcaatcagcatatcattaaaaacgagggagataagcccaaattagacttctga

SEQ ID NO: 2783 - RNA, 3366 nt, synthetic construct
  misc_feature 1..3366: note = Cas9 variant
  source 1..3366: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggcgcgtgagactgaataggctatttgaggaatcaggcctcattacggacttcaccaagatcagtataaacctgaatccttaccagcttcgggtcaaaggtctgacagatgagttgagcaacgaagaactctttatcgccctgaagaatatggtgaagcaccgcgggatttcctatctggacgatgcgtctgacgatggaaactcgtcaatcggcgactacgctcagattgttaaagagaatagcaagcagctcgaaactaaaaccccaggccaaatccagttagagcgatatcagacatacgggcagctgagaggagatttcaccgtggaaaaggacggtaaaaagcataggcttataaacgtctttccgactagcgcctatcggtccgaggcattgcgtattctgcaaacacagcaggagttcaatccccagatcaccgatgaatttattaaccgctacctagagatcctcacgggcaagagaaaatattaccacgggcctggaaatgaaaagtctaggactgactacggccggtatcgaaccagcggtgagacactggataacatcttcgggattcttataggaaaatgcactttttacccagacgagttccgcgccgctaaggcatcctataccgcccaagagtttaacctgttgaatgacctcaacaatctgacagtgcccaccgagacgaaaaagttatcaaaagaacagaagaaccagatcattaattacgtaaagaacgagaaagctatgggccctgccaagctgttcaaatatatcgcgaagctccttagttgtgatgttgcagacataaaaggctacagaattgataagagcgggaaggccgaaatccatacttttgaggcttataggaaaatgaagacactggaaaccttggacatcgagcaaatggatcgggagactctagacaaactggcctacgtgctcacactgaataccgaacgcgagggtattcaggaagcacttgagcacgagttcgctgatggatctttctcccagaagcaggtcgacgaactggtgcaatttagaaaagccaactcaagcatcttcggcaaggggtggcacaattttagtgtgaagttgatgatggagctcattccagaactgtacgagacgtctgaggaacagatgaccatattaacaaggctgggaaaacagaagactacctccagctcgaacaaaacaaagtatatcgatgagaaactactcactgaagagatttacaatcccgtcgttgcgaagtctgtgcgtcaggccatcaagatcgtaaacgcagctattaaagaatatggcgacttcgataatatagtgatcgagatggcccgggaaaccaacgaggacgacgagaagaaagctattcaaaagatccagaaagccaataaggatgaaaaagacgcagccatgctgaaggctgcgaaccagtacaacggtaaggcagagcttcctcattccgtctttcacgggcataaacagttggccacaaagattcgactgtggcaccaacagggcgaaagatgcctctataccggaaaaactatctcaatacacgatctgatcaataacagtaatcagttcgaggtggaccatattcttccactgagcatcacgtttgatgactccttggctaacaaggttctcgtgtacgccacagcaaatcaggaaaaaggccaaaggaccccgtatcaggccctggattctatggacgatgcttggagcttccgcgagttaaaggcctttgtccgggagtcaaagactctgagtaacaaaaagaaagaatacctactcaccgaggaagacatttccaagttcgatgtgaggaaaaagtttatcgagagaaatctggtagacacacgctacgcaagccgagttgtgcttaacgcgttgcaggaacacttccgggctcataagatagataccaaagtctctgtggtccgtgggcaatttacttcacagctgagaaggcactggggaattgagaagacacgcgacacgtatcatcaccacgccgtggacgcactcatcattgccgctagtagccagctgaatttatggaaaaagcagaaaaacaccctggtttcctactctgaggatcaacttttggacatcgaaactggtgagctcatatcggatgacgaatataaggagagcgtgttcaaggccccctaccagcatttcgtagatacactgaaatccaaggagtttgaagactcaatcctattcagttatcaggtcgattctaaatttaatcggaagattagcgacgcaaccatctacgctacaagacaggccaaagtgggcaaggataaagcggacgagacttatgttctggggaagattaaggatatctacacccaagacggatacgatgccttcatgaaaatatataagaaagacaagtccaaatttctcatgtacaggcacgaccctcagacgttcgaaaaggtgattgagccaatcctggaaaactatcccaataagcagatcaacgagaaaggcaaggaggtcccttgtaatccatttcttaaatacaaggaggaacatggttatattcgaaaatactcaaagaaggggaacggccccgaaatcaaaagtttgaagtattacgattctaaactgggaaaccacattgacataaccccgaaggattccaataacaaagtggtattacagagtgtgagcccttggcgcgctgacgtttacttcaataagacaactggcaagtatgagatcctcgggctgaaatacgcagatcttcaatttgaaaagggaaccggtacatataaaatttctcaggagaagtacaacgacatcaaaaagaaggagggcgtcgattccgactcagagttcaaatttactctgtataagaatgatttgctcctggtgaaagacaccgaaacgaaggaacagcaactattccggtttctgagtagaacaatgcccaaacagaagcactacgtggagctcaaaccatatgataagcagaagttcgaagggggagaggccctgattaaagtccttggcaacgttgctaatagcggtcagtgcaagaaagggttgggcaagtcgaacatctccatatacaaagtgaggaccgacgtgctgggaaatcaacatatcattaagaacgagggcgacaagcctaaattagatttctga

SEQ ID NO: 2784 - RNA, 3366 nt, synthetic construct
  misc_feature 1..3366: note = Cas9 variant
  source 1..3366: mol_type = other RNA
atgagcgacctggtgctcggccttgatatagggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggcgcgtgagactgaataggctatttgaggaatcaggcctcattacggacttcaccaagatcagtataaacctgaatccttaccagcttcgggtcaaaggtctgacagatgagttgagcaacgaagaactctttatcgccctgaagaatatggtgaagcaccgcgggatttcctatctggacgatgcgtctgacgatggaaactcgtcagttggcgactacgctcagatcgtgaaagagaatagcaagcagctcgaaactaaaaccccaggccaaattcagttagagcgatatcagacatacgggcagctgagaggagatttcaccgtcgaaaaggacggtaaaaagcataggcttatcaacgtgtttccgacaagtgcctatcggtccgaggcattgcgtatactgcaaactcagcaggagttcaatccccagattaccgatgaatttgtaaaccgctacctagagatcctcacgggcaagagaaaatattaccacgggcctggaaatgaaaagtctaggactgactacggccggtatcgaaccaacggtgagacactggataacattttcgggatccttatcggaaaatgcactttttacccagaagagttccgcgccgctaaggcaagctataccgcccaagagtttaatctgttgaacgacctcaataacctgacagttcccaccgaaacgaaaaagttatccaaagagcagaagaatcagattataaactacgtgaagaatgaaaaagctatgggccctgccaagctgttcaaatatatcgcgaagctcctttcatgtgacgtcgcagatattaaaggctacagaatcgacaagagtgggaaggccgagatacatacttttgaggcttataggaaaatgaagacactggagaccttggatattgagcaaatggaccgggaaactctagataaactggcctacgtgctcacactgaacaccgagcgcgaaggaatccaggaggcacttgaacacgagttcgctgacggtagcttctctcagaaacaggtggatgagctggtccaatttagaaaagccaattcctcaatcttcggcaaggggtggcacaactttagcgttaagttgatgatggaactcattccagagctgtacgaaacgagtgaggagcagatgaccatcttaaaaaggctgggaaagcagaaaacaacttcttccagcaataagaccaaatatattgacgaaaagctactcacagaggaaatatacaaccccgtggtagcgaagtcgatccgtcaggccattaaaatcgtgaatgcagctatcaaggagtatggcgatttcgacaacattgtcatagaaatggcccgggagactaatgaggatgacgaaaagaaggctatccagaaaattcaaaaggccaacaaagacgagaaggatgcagccatgctgaaggctgcgaaccagtacaatggtaaagcagaacttcctcattctgtgtttcacgggcataagcagttggccaccaaaatccgactgtggcaccaacagggcgagagatgcctctatacaggaaagaccatttccatccacgacctgataaacaatccaaaccagttcgaagttgatcatatccttccgctgtcaattacttttgacgatagtttggctaataaagtgctcgtctacgccacggcaaaccaggagaagggccaaaggacaccctatcaggccctggacagcatggatgacgcttggtccttccgcgagttaaaggcctttgtgcgggaatctaaaaccctgagcaataagaaaaaggagtacctactcactgaagaggatatctcaaaattcgacgtaagaaagaagtttattgaaaggaacctggttgatacccgctacgcaagtcgagtggtccttaatgcgttgcaggagcacttccgggctcataaaatcgacacaaaggtgtccgtcgtgcgtgggcaatttaccagccagctgagaaggcactggggaatagagaaaactcgcgatacatatcatcaccacgccgttgacgcactcattatcgccgcttcttcacagctgaacttatggaagaaacagaagaatacgctggtgagttacagcgaagaccaacttttggatattgagaccggtgaactcatctccgacgatgagtataaggagtctgtattcaaagccccttaccagcatttcgtcgacactctgaagtcgaaagaatttgaggatagcatactattctcctatcaggtggactcaaagtttaaccggaaaatcagtgatgcaacaatttacgctaccagacaggccaaggttggcaaagacaagaaggatgaaacatatgtgctggggaaaatcaaggacatttacactcaagatggatacgacgcgttcatgaaaatctataagaaagataagtctaagtttctcatgtacaggcacgacccacagaccttcgagaaagtcatagaacccattctggagaattatcctaacaaggagatgaatgaaaaaggcaaggaggtgccatgtaacccctttcttaaatacaaggaggaacatggttatatccgaaagtacagcaaaaaggggaacgacccggaaatcaaatccttgaagtattacgattcaaaactgggcaatcacattgacatcacgcctaaggatagcaacaataaggtagtgttacagtctgtttccccctggcgcgccgacgtctacttcaacaaaaccacaggaaagtatgagattctcggcctgaaatacgctgatcttcagtttgagaaggggactggaacctataaaataagtcaagaaaagtacaatgacatcaagaaaaaggagggtgtggatagcgactctgagttcaaatttacactgtataagaacgatttgctcctggtgaaagacactgaaaccaaggaacagcagctattccggtttctgtccagaacgatgccaaaacaaaagcactacgtcgagctcaagccttatgataaacagaagttcgagggcggggaagcactgattaaagttcttggaaatgtggccaactcaggccagtgcaagaaaggtttggggaagagtaatatcagcatttacaaggtgaggacagacgtactgggcaaccagcatatcatcaaaaatgagggagacaagcccaaattagatttctga

SEQ ID NO: 2785 - RNA, 3366 nt, synthetic construct
  misc_feature 1..3366: note = Cas9 variant
  source 1..3366: mol_type = other RNA
atgaacggcctggtgctcgggcttgacatcggaattgccagcgtcggtgttggcatactggagaaaaattccgggaaaatcattcacgctaactctagattgttccccgcagccaccgcggataataacgtggaaaggcggaagaatcgccaggctcgacgtttacatagaaggaaaaagcaccggggagtacgctttcaagacctgttcgaggattacggcctactcacagacttttcaaaagtgagtatcaacctgaatccttatagacttagggtcgatggtctgaaccagcagttgactaatgaagaactcttcattgccctgaagaacatcgtgaagcggcgcgggataagctacctggacgatgcatccgaagacggaggcacggtttcttcggattatggcaaagccgtggaggagaatcgaaagctcttagctgaacagaccccagggcaaatccagctggagagatttgaaaaatacggacaggtcaggggtgacttcacagtggtagagaacggcgagaagcggcgtcttattaatgttttctcaactagcgcatatcgcaaagaagccgagagaatcttgaggaagcagcaagaatttaacagtaagattaccgatgagtttatcgaagactgcctgaaaatactaacagggaagcggaaatactatcatggaccgggcaatgagaagtcccgaaccgattacggtcgcttcagaactgacgggacaaccctcgacaacatttttggaatcctgattggcaaatgtacgttctaccccgatgagtatagggcttctaaggccagctacactgcgcaggaatttaaccttctgaatgacttgaacaatctcaccgtgcctacagagactaaaaagctgtccgaggagcagaagaaagtcatcgtggaatatgcaaaggaggccaaaaccttaggcgcttcaacactgctcaagtacatcgccaaaatgattgatgcaagtgtggaccagatacgggggtatcgcgtcgatgttaacaataagccagagatccacaccttcgaggcttacagaaagatgcaaagccttgaaacgatttctgtgggagaactgtccaggaacgtattggacgagctagcccatatcctgactctcaatacagaacgtgagggtatagaggaagcgattaacaccaaactgaaggattcattcagccaggaccaggtgcttgagctggtccaatttcggaaaaataacagttctttgttctccaagggctggcacaattttagcctcaaactgatgatggaattaatccccgagctgtatgagacttcggaggaacagatgacaatcctaacccgactcgggaagcagaagtctaaagaaatttccaagagaacgaaatacatcgatgagaaggaactgaccgaggagatttacaaccctgtggttgccaaatcagtgaggcaggcaataaagatcattaatgaagctacaaagaaacacggaatcttcgacaacatcgtcattgagatggcccgcgaaaataacgaggaagatgctaagaaagactatataaagcggcaaaaagccaaccaggacgagaagaatgcagccatggagaaagctgcgtttcagtacaacggcaagaaggaacttccagatagtatcttccatggtcagaaagagttggcaactaagattagactgtggcaccaacagggggaaaaatgcctctataccggcaagaatatccccattagcgacctgatccataaccagtacaaatatgagatagatcacatccttcctctgtccttgtcttttgacgatagcctctcaaataaggtgctggtattagccacagctaaccaggaaaagggacaaaggactccattccaggccctggacagtatggatgacgcatggtcctaccgcgagtttaaaagctatgttaaggagtctaaactactcggcaataagaaaaaggaatacctgcttaccgaggaagatatttcaaagatcgaggtgaaacagaagttcattgagcgaaacttgatcgacacacggtacagtagccgtgtcgtgctgaatgccctccaggatttttataaagctcacaagttcgacaccactatatccgtcgtgagagggcaatttacgtctcagctgaggcgcaaatggggattagaaaagtcgcgggagacataccatcaccatgccgttgatgcactgattatcgcggctagctcccagcttagattgtggaagaaacaaaacaatccgctcattgcctataaggaaggtcagttcgtggactcagagaccggcgaaatcataagtctgtctgacgatgagtacaaagagctagtattcaaggcaccctatgaccactttgtcgatactctgagctccaaaaccttcgaagactcaatcctctttagctaccaggtggattctaagttcaacaggaaaatttccgacgccacaatctatgctacccgaaaggccaagctggataaagagaagagtgaagagacttacgttcttgggaaaattaaggacatctacagccaggcaggatatgatgcttttataaaaatttacaataaggacaagtctaaattcttgatgtatcataaggatcctcaaacatttgaaaaagtgatcgaggagatcctgcgcacgtacccatccaaggaattaaacgacaaaaataaggagattccctgtaaccctttcgaaaagtatcggcaggagaacggcccaatcagaaaatactcaaagaaaagtaatggtcccgaaattaagagcctcaaatattacgataacaagctggggaatcacatagacatcaccccggagtcgtccgacaaccaggtcgtgcttcagtctctgaagccttggaggactgatgtatactttaatcaccaaacaaagaagtatgagttgatgggcctcaaatacagcgacctgtcattcgaaaagggaagtggcaaatattccatttctaaccagaagtacaatagcatcaagcgtattgaggggatcgatgaacagtccgagtttaaattcaccctatataagaacgacctgatactcatcaaagattcagagaataacgaacagaagctgtttcgcttcaatagccggaacgacacagccaaacattacattgagcttaagccctatgataaagcgaagttcgacggagaacaagagttgatcactattctgggtaatgtggccaagggcgggagatgcttaaaaggactcaacaagagtaatatctctatatttaaagttaagaccgatgtcctgggcaaaaagcacattatcaagaaagaaggtgacgagccaaaacttaagttctga

SEQ ID NO: 2786 - RNA, 3366 nt, synthetic construct
  misc_feature 1..3366: note = Cas9 variant
  source 1..3366: mol_type = other RNA
atgaacggcctggtgctcgggcttgacatcggaattgccagcgtcggtgttggcatactgaataaggataccggggagatcattcacacaaactccagaatcttccccgctgcaactgccgacaataacgtggaaaggcgcaattctcggcaggatcgacgtttgaacagaaggaaaaagcatcggggagtacgcttacacgacctgtttgaggattacgacctactcacggatttctcaaaagtgagtattaatctgaacccttatagacttagggtccaaggcctggacaatagcttgaccacagaagaactctttatcgcgctgaagaacatagtgaaacggcgcggtatctcctacctggatgacgcttctgaagatgggggagttgtgtcgtcagactatggcaaggccgtcgaggagaatcgaaagctcttagcagaacagactccaggccagattcagctggagagattcaaaaagtacgggcaagtgaggggagattttaccgtagttgaaaacggtgagaaacggcgtcttatcaatgtgttcagcacaagtgcctatcgcaaggaggctgaaagaattttgaggaaacagcaggagtttaacaatcagatcaccgacaagttcatagaagactacctgaagattctaactgagaaacggaagtattaccatggcccggggaacgaaaaatcccgaacagattacggacgctttagaaccgacggcacgactctcgataacatcttcggtattctgatcgggaagtgcaccttttatcccaatgagtacagggcatctaaagccagctatacagctcaagagttcaaccttctgaatgacttgaacaatctcactgtccctaccgaaacaaagaaactgtccgaggaacagaagaagaccatcgtggagtacgccaaatcagcgaagacgttaggagcaagtactctgctcaaatatattgccaagatgatagatgctagcgtggaccagatccggggctaccgcgtcgatgttaacaataaaccagaaatgcacacatttgaggtgtatagaaagatgcagtctcttgagaccatttccgtatgggaactgtcaaggaacatcttggacgagctagcccatatactgactctcaatacagaacgtgagggcattgaagaggcaatcaacaccaagctgatggatgtgttcagccaagaccaggtccttgagctggtgcagttccggaaaaataacagttctttgttttccaaggggtggcacaatttcagccgaaaactcatgatggaactgatccccgagttatacgaaacgtcggaggagcaaatgaccattctgacaagactaggaaagcagaaatctaaggaaacttccaagaggaccaaatacatcgatgagaaggaagttacagaggaaatttataaccctgtggtcgctaaatcagtgcgccaggccataaagatcattaatgaggcgactaaaaagtacggtatctttgacaacatcgtaattgagatggcccgggaaaacaatgaggaagacgcaaagaaagattatataaagagacagaaagctaaccaagacgagaagaatgttgccatcgaaaaagctgccttccagtacaacggcaagaaagagctcccagatagtatttttcacgggcataaggagctggcaaccaagatcaggctttggcaccagcagggagaaaaatgtttgtatacaggcaagaatattcccatcagcgacctgatacataaccaatacaaatatgagatcgatcacattctccctctgtccctttctttcgacgatagcctgtcaaataaggtgttggtcctcgccaccgctaaccaggaaaaaggtcagcgcactccatttcaggcgctggacagtatggatgacgcatggtcctaccgagagttcaagagctacgtgaaggattctaaattactggggaataagaaaaaggactatctactcacggaagaggatatctcaaaaattgaggtcaagcaaaagtttatcgaacggaacctggtggacacacgttacagtagcagagttgtgcttaataccttgcaggacttctataaagcccacaagtttgatactaccatatccgtagtcaggggccagttcacatctcagctgcgccggaaatggggactcgagaagtcgagagaaacctaccatcaccatgctgtggacgccctgattatcgcagccagctcccaattaaggctgtggaaaaagcaggctaacccgcttatttcatataaggaggatcagtttgttgacagtgagactggcgaaatcatatctttgacagatgacaaatacaaggagctcgtgttcaaagccccctatgcacacttcgtcgatacgctgagctccaagaaatttgaagactcaatcctattcagctaccaagtggattctaagtacaatcgaaaaatttccgacgcgaccatctatgctactcgcaaggtaaagctggataaagacaagagtgaggaaacatacgtgctcgggaaaattaaggatatctatagccaggccggatacgacgcatttataaaaatttataacaaggacaagtctaaattcctgatgtaccataaggatcctcagacctttgagaaagttatcgaggaaatccttcggatttatccatccaaggagttcaatgagaaaaacaaggaggtcccctgcaacccttttgaaaagtacagacaggagaatggtccaatctgtaaatactcaaagaaaggcaacgggcccgagattaagagtttgaaatattacgacaagaatataccggaaagtttcatcgatattacaccttcgaactccaagaataaagtgatcctgaggcaattaaacccctggcgtactgacgtgtattttaatcaccagaccgagaagtacgaactcctgggacttaaatatgccgatctgcagttcgagaagaaaacggaaacctactctattacaatcgacaagtataacgagataaaggagaaagaaggcgtcggtgagcacagcgaatttaagttcactttgtacaaaaatgatctcctgctaatcaaggacatggagattaaagaggaacagatctttcgcttcctgtcacggaccatgccaaacaagaaacattacgttgagctcaagccttattacaaggggaatttcgaaggcaaagagagaattaaggtgtttaacacaactagcaatggaaggtgcctgaaaggccttgggaagaaaggattgtccatctataagataaagaccgatgtgctgggtaacaaacacttcattaagaaagaaggcgagaagcccaaattaaagttttga

SEQ ID NO: 2787 - RNA, 3366 nt, synthetic construct
  misc_feature 1..3366: note = Cas9 variant
  source 1..3366: mol_type = other RNA
atggacagaaccgaggtgaacatcggcttcgatattgggataagctccgtcggatggtctgttgtggccacaaagtcaggtaggatcctggaaagtggcgtaagcctcttttccggggcttctgcagccaaaaatgaggaacggcgcaacttccgacagtcgcgtagacttctgaggcggcgcaagaatagaatttcagacttgaaaaagtacttaaaagagcagagctttacttataacggagaactgctaaatgagaacccctacgagatcagggtgaagggcctcacggaaaagctgagtaaagaggaaattgcgcttgctctgttgcacatcgtcaagcggcgcggtgtgtcctatgatctcggggacatagaggaggaaggaaccacaggctcttacaaagagggcgttaagaaaaatcaaaagctgctgaaggaaaagactcctgccgagatccagttccagcgactcaagaaatttcataaggtgagagggcaaattgcaatcgatgaaaacgacgtcttactgaatgtgttcccaaaccacgcctatgtagatgaggctcagcagattctttacacccagcaagagttttatccggaaatcaatgagacattcataaaccaggttaccgactttattagcaggaaacgggattacttcatcggacccggttccgaaaagtcacgtactgactacggcatttatcgcacagatgggaccacgttgcagaatctgtttagtatcctaatcggaaaagacaagattttccctgatgagtttagagcagccggcaacagctacactgctcaggtgtataatctcctgaacgaccttaacaatctggccatagacgataccgaaacaggtaagttgactaaacaacagaaggagaaaatcattatggagctcaagaccacagaaaaatctgtcaacatgatgaagctgatcgcgaagaccgcaggggtgacggtggagcagatatccaggtaccggattaatcgagacggaaaatcagaaatccataacatggccgtctatcgcaagatcagaaaagttttcttagagctgggctacgaaattaatgagtggccaagccaactccttgatgagctgggcgacgctttgagtctaaacactgaaaatggggagatcaggcggattctgacagataacctcgccaataagtataaaatactggaccagcagcttatcaacctgattatcgaaaataagaacgcattcaccttgtctactaatcagaagtggcaccgcttttcctacaaaacaatgaagatcctcattcccgagctgttagagaccaacaaagaacaaatgacgatactgaccgagatgggactaatgaagaaagatcagagaaattacgtgggtaagaacaagatcgacagcgaagctctcctggagaacctttataatcctgtagtgaggaaatcgacacgtcagactatgaagttgttcaacaccctgctcaaaaagtacccaaatattgcctatgtcgtgatcgaaatgccccgggaggatgacgaggataaagcgcgaagagactacgttaagtttcagaaagacaacgaaaaggagaaggatgccgcactgaaaaatttcattatggaatctggcaagtccgaggctgaagtgatcgccaaatataggcaatcaaagaaatttcgcagtaaggtccggctttggtaccagcagatggggagatgcctgtatagcggaaaggctatgcctgccgagagggtgttccgcgacgatcattttacagacatagatcacgtaatcccattgtccgtttctttcgacgatggcatgaacaataaagtgctctgtctggcagagatgaaccgacagaaggacaaacaaactccgtacgcctttttcaatgctggtcacgggcagggctttcaggcgatgaacgcaatgttaaagaataacaatcggattagctcagccaaaaagcgtaacctgctattcaccgaaaatctcaacgatctggaggtcagaaagaggtttatcgaacgcaaccttgtggacacacggtacgctagtagagtcgtgttgaatgagctgcagcaattcgttaaagccaagcagctcgataccaaagtgactgtaattaggggaaagttcacgtccaaactgcgagaaaagtggaacatcaataagagccgcgacacacatcaccatcacgcagtcgatgccgctgtgatagccgtttctcccatgttaaacctgtgggagaaaggcgcatcaattatccctaataaggtgggggagaacgtcattgacatcaaaaccggagaaataatcactgaccacgattatgaggcggacgtgtacgaacttccatatgctaagtttttggagcagattcccaaagtaaagaaagatatcaagttccggcatcaagtggacaagaaaaagaatagaaaagttagtgatgccaccatttacacaaccaggaaggcaaaagtcggtaaggacaaggaggaaactgattatgtgctcggcacaatcaaagacatatacagcctggaggggtatgtgtcctttaagaaaatttacaacaaggataaagccaagttcctaatggctcgtatcgaccctaagacgtttgaaaaactggagaagatcgtcgccgaatacccagagtctattgaggttgtgcaggataatggaaaagtggacgtacagaagatctcgcccttcgaactctatcgcaaagataacggctttgtcaccaagttcgcaaagaaaaataacggtccggctgttaagagcctgaaatactatgactccaaacttgggtcaagtattgacgtgactcctgataatgccaaaaacaagaaggtgatattgcagtctctgaaaccctggcggacagacgtctactttaatgaggaaaaccaagagtatgaaatcatgggcttaaagtacagcgatctcaaattcggaaagaacggcaaatatggggtgccaaaggttagatacgaggagattaaacaggaagaggaaatctccgagggatcaaagtttctgttcagcctttacaggggtgaccgaattaaggtgaccaatgaactgggcgagaacttggatctcctgttttcttcccggacactacctgcgcagaaagggtatgtagagctgaagcccatcgacaaaactaagttcgatggaaaagaaaaggtcagtttctacggcaccgtgacgccaaatggtcagtttgtgaagaaattcgccaagaaagggtataagatactcaaactgaacaccgacgagcttggcaatacatacatcgaaaacggagagaaggagcccagcgatattttggacatgtga

SEQ ID NO: 2788 - RNA, 3366 nt, synthetic construct
  misc_feature 1..3366: note = Cas9 variant
  source 1..3366: mol_type = other RNA
atgaacggcctggtgctcgggcttgacatcggaattggtagcgtcggcgttgggatactgaataaggataccggagagatcattcacgccaactccagaatcttccccgctgcaacagccgacaataacgtggtaaggcggtcttcacgccagggccgacgtttgaatcataggaaaaagcacagaagtgtgcggttaaaagatctgtttgaatactatgacctactcactgatttcagcaaggtctccattaacctgaatccttaccgccttagagtgaacggtctgaatcaacagttgacgaacgaggaactctttatcgcgctgaaaaatatagttaagaggcgggggatctcttatctggacgatgcttcggaggacggaggcgccgtgtcaagcgattacggcaaggcagtcgaagagaaccgcaaactcttagccgagcagaccccagggcagattcaactggaacgattcgagaagtatggacaggtgagaggtgactttacagtagttgaaaatggcgagaaaaggcggcttatcaacgtgttcagtacttccgcttacaagaaagaggcagaacgtattttgcgcaagcagcaggagtataataaccaaatcatggatgaatttatagccgactacctgaccattctaacagggaagagaaaatactatcatggaccgggcaacgagaagtctaggaccgattacggtcggttccgaactgacgggacaaccctcgacaatatctttggcattctgatcggaaaatgcacgttctatcccgaaaagtaccgcgctagcaaagcctcctatactgcgcaggagtttaaccttctgaatgatttgaacaatctcaccgtccctacagagactaagaaactgtcagaagaacagaagaagaccatcgtggaatacgcaaaaagtgccaagacattaggcgctagcaccctgctcaaatatattgccaagatgatagacgcatctgtggatcagatcagagggtacagggtcgacgttaaaaacaagccagagatgcacacgttcgaagtgtaccggaagatgcaatcccttgagactatttcagtaggagagtttagccgcgaagtgctggatgagttggctcatgtcctaacactgaataccgaaagagagggtatcgaagaggccataaacactaaactcagggacagtttctctcaggatcagattctggagcttgtgcaattccgtaagaataactccagcctgttttcgaaaggctggcacaatttctctttgaagctcatgatggaactgatccccgagttatatgaaacatccgaggagcagatggcgatcctgacccggctagggaaacagaagtttaaggaaacgtcaaaacgaaccaagtacattgacgagcaggaagttacagaggaaatctataaccctgtggtcgccaaaagtgtgagacaagcaattaagataatcaatgaggctactaaaaagtacggaattttcgataacatcgtaatcgagatggccagggaaaataacgaggaagaggctaagaaagactatattaagcgccagaaagccaaccacgatgaaaagaatgcagccatggagaaagctgcgtttcagtacaacggcgagaaggaactcccagacagcatattccatggtcacaaagagctggcaaccaaggttcggctttggcatcagcaaggggaaaagtgtttgtatacaggcaaaaatatccccatttccgacctgatccacaaccagtacaagtacgagattgatcacatcctccctctgtctcttagctttgacgattcactgagtaataaagtgttggtcctcgccactgctaaccaggaaaagggacagagaaccccattccaagccctggactccatggatgacgcatggagctatagggagtttaaatcttacgtgaaggattcaaagagtttaggcaataaaaagaaagactatctgctaacagaggaagatataagcaagatcgaggtcaaacagaagttcattgaacgcaacctcgtggacacccgatactcctctcgggttgtgctgaatactcttcaggatttttataaggcccataaattcgacacgacaatctcggtagtccgtgggcagtttaccagccaattgagaaggaagtggggactggagaaatcccgcgagacttaccaccatcacgctgtggatgccctcattatcgcagcgtcaagtcagctgcggttatggaagaaacagaacaatccgctgatatcttataaggaaggtcaattcgttgacagcgagaccggcgaaattatctcccttacagacgatgagtacaaggaattggtgttcaaagctccctacgaccattttgtcgataccctcagatcaaagaaattcgaggacagcattctgttttcttatcaggtggattccaagttcaacaggaaaatcagtgacgccactatatacgcaacacgaaagacgaaactagataaggacaagagcgaggaaacctatgtactggggaaaatcaaggatatttactctcagtccggatatgacgcctttatcaaaatttacaataaggataaatcaaagttcctcatgtatcacaaggaccctcagacttttgagaaagtgatcgaagagatactgcgcacatacccaagtaaggagttcaacgagaaaaataaggaggttagctgcaacccctttgaaaaatacaagcaagagaacggccctattcggaagtattcgaaaaagggtaatgggccagaaatcaaatcccttaagtactatgataaaaacatccccgagtctttcattaatatcaccccgagcaactcaaagaataaggtcattttgagacagctgaacccttggaggacagacgtgtactttaatcaccagactgaaaaatatgagttactcggcctgaagtacgctgaccttcagttcgagaaaaagaccggaacgtatagtataaccatcgataaatacaacgaaattaaggagaaggaaggcgtgtccgagcattctgagtttaaattcacactgtacaagaatgacttgctcctgatcaaagatactgaaattaaggaggaacaaatcttccgttttctaagccgcaccatgcccaaccagaaacactatgtcgagctgaagccatactataaagggaatttcgaaggaaaggagcggataaaggtttttaacacaacttccaatggtagatgtctcaaaggcctgaggaagaaagggctttcaatctacaagattaaaaccgacgtgttgggaaacaagcatttcatcaagaaagagggcgaaaagcctaaactgaagttttga

SEQ ID NO: 2789 - RNA, 3366 nt, synthetic construct
  misc_feature 1..3366: note = Cas9 variant
  source 1..3366: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggattgtgcgcctgaatagactatttgaggaatcaggcctcatcacggacttcaccaagataagtatcaacctgaatccttaccagcttagggtcaaaggtctgacagatgagttgagcaacgaagaactctttattgccctgaagaatatggtgaagcaccgggggatctcctatctggacgatgcgtctgacgatggaaactcgtcagttggcgactacgctcagattgtgaaagagaatagcaagcagctcgaaactaaaaccccaggccaaatccagttagagcgctatcagacatacgggcagctgcgaggagatttcaccgtcgaaaaggacggtaaaaagcatagacttataaacgtgtttccgactagcgcctataggtccgaggcattgcggattctgcaaacacagcaggagttcaatccccagatcaccgatgaatttattaaccgttacctagagatcctcacgggcaagcgcaaatattaccacgggcctggaaatgaaaagtctagaactgactacggcaggtatcggaccagcggtgagacactggataacatcttcgggattcttataggaaaatgcactttttacccagacgagttccgagccgctaaggcatcctataccgcccaagagtttaacctgttgaatgacctcaacaatctgacagtacccaccgagacgaaaaagttatcaaaagaacagaagaaccagatcattaattacgttaagaacgagaaagctatgggccctgccaagctgttcaaatatatcgcgaagctccttagttgtgatgtggcagacataaaagaataccgcattgataagagcggcaaggccgagatccatacttttgaggcttatagaaaaatgaagacactggaaaccttggacatcgagcaaatggatagggaaactctagacaaactggcctacgtcctcacactgaataccgagcgggaagggattcaggaggcacttgaacacgagttcgctgatggatctttctcccagaaacaggtggacgagctggtgcaatttcgcaaggccaactcaagcatcttcggtaagggctggcacaattttagtgtcaagttgatgatggaactcattccagagctgtacgaaacgtctgaggagcagatgaccatattaacaagactggggaaacagaagactacctccagctcgaacaaaacaaagtatatcgatgaaaaactactcactgaggaaatttacaatcccgttgtggcgaagtctgtaaggcaggccatcaagatcgtgaacgcagctattaaagagtatggagacttcgataatatagtcatcgaaatggcccgtgagaccaacgaggacgacgaaaagaaagctattcaaaagatccagaaagccaataaggatgagaaagacgcagccatgctgaaggctgcgaaccagtacaacggcaaggcagaacttcctcattccgtgtttcacggtcataaacagttggccacaaagattcggctgtggcaccaacagggggagcgatgcctctataccggcaaaactatctcaatacacgatctgatcaataacagtaatcagttcgaagttgaccatattcttccactgagcatcacgtttgatgactccttggctaacaaggtgctcgtctacgccacagcaaatcaggagaaaggacaaagaaccccgtatcaggccctggattctatggacgatgcttggagcttcagggagttaaaggcctttgtgcgcgaatcaaagactctgagtaacaaaaagaaagagtacctactcaccgaagaggacatttccaagttcgatgtacggaaaaagtttatcgaaagaaatctggttgacacaaggtacgcaagccgcgtggtccttaacgcgttgcaggagcacttccgagctcataagatagataccaaagtgtctgtcgtgcggggccaatttacttcacagctgcgtagacactgggggattgagaagacaagggacacgtatcatcaccacgccgttgacgcactcatcattgccgctagtatccagctgaatttatggaaaaagcagaaaaacaccctggtgagctactccgaagatcaacttttggacatagagactggagaactcatctctgatgacgagtataaggagtcggtattcaaggccccctaccagcatttcgtcgatacactgaaaagcaaggaatttgaggactccattctattctcatatcaggtggatagtaaatttaatcgcaagatctctgacgcaaccatttacgctacacggcaggccaaagttggtaaggataaagcggacgaaacttatgtgctgggcaagatcaaggatatatacacccaagacgggtacgatgccttcatgaaaatttataagaaagacaagagcaaatttctcatgtacagacacgaccctcagacgttcgagaaggtcatcgaaccaatcctggagaactatcccaataagcagattaacgagaaaggaaaggaagtgcctgtaaatccatttcttaaatacaaggaggaacatggctatatcaggaaatactccaagaagggtaacgggcccgagattaaatcattgaagtattacgatagcaaactgggcaaccacatagacatcaccccgaaggattctaataacaaagtggttttacagtccgtcagtccttggcgagctgacgtgtacttcaataagacaactggaaagtatgaaattctcggcctgaaatacgcagatcttcaatttgagaaggggaccggaacatataaaatcagccaggagaagtacaacgacattaaaaagaaggaaggtgtggattctgactccgagttcaaatttactctgtataagaatgatttgctcctggtcaaagacaccgaaacgaaggagcagcaactattccgctttctgtcacggacaatgcccaaacagaagcactacgttgaactcaaaccatatgataagcagaagttcgagggcggggaggccctgatcaaagtgcttggaaacgtggctaatagtggccagtgtaagaaaggtttggggaagagtaacatatcgatctacaaagtaagaaccgacgtcctgggcaatcaacatattatcaagaacgaaggagacaagcctaaattagatttctga

SEQ ID NO: 2790 - RNA, 3366 nt, synthetic construct
  misc_feature 1..3366: note = Cas9 variant
  source 1..3366: mol_type = other RNA
atgaacggcctggtgctcgggcttgacatcggaattgccagcgtcggtgttggcatactggagaaaaattccgggaaaatcattcacgctaactctagattgttccccgcagccaccgcggataataacgtggaaaggcggaagaatcgccaggctcgacgtttaaacagaaggaaaaagcatcggggagtacgctttcaagacctgttcgaggattacggcctactcacagacttttcaaaagtgagtatcaatctgaacccttatagacttagggtcgatggtctgaatcagcagttgactaacgaagaactcttcattgccctgaagaatatcgtgaagcggcgcgggataagctacctggacgatgcatccgaagacggaggcgccgtttcttcggattatggcaaagctgtggaggagaaccgaaagctcttagcagaacagacgccagggcaaatccagctggagagatttgaaaaatacggacaggtcaggggtgacttcaccgtggtagagaatggcgagaagtgccggcttattaacgttttctcaacaagcgcctatcgtaaagaagctgagaagatcttgcgcaagcagcaagaatttaataaccagattactgatgagtttatcgaagactacctgaaaatactaaccgggaagagaaaatattaccacggaccgggcaacgagaagagtaggacagattacggtcggttccgaaccgacgggactacactcgacaatatttttggagtgctgatcggcaaatgtaccttctatcccaacgagtaccgcgcctccaagtctagctatacggcgcaggaatttaatcttctgaacgatttgaataacctcactgtccctaccgagacaaagaagctgtccgaggagcagaagaaagtgattgtggaatacgcaaaggaggccaaaactttaggcgcttcaaccctgctcaagtatatcgtcaaaatgatcgacgccagtgttgatcaaattagcgggtacagagtggacgtaaataacaagccagagatgcatacattcgaagtgtataggaagatgcagtctcttgagaccatatccgtcggagaactgtcacggaatgtgttggatgagctagcacacatcctgacgctcaacactgaacgcgagggtattgaggaagctatcaatagcaaactgatgggcgttttcagtcaggaccaagtgcttgagctggtccagtttagaaagaacaattcttccttgttcagcaaagggtggcataacttttcgctcaagctgatgatggaattaatacccgagctgtacgagacatctgaggaacagatgaccattctaactaggctcggaaaacagaagtccaaggaaacatcaaaacgtaccaagtacatcgatgagaaagaactgacggaggagatctataatcctgtggtagccaagagtgttcggcaagcgattaaaatcattaacgaagccaccaagaagcacggcatattcgacaacatcgtgattgagatggcacgagaaaataacgaggaagatgctaaaaaggactacatcaaaagacagaaggccaatcaggatgagaaaaacgctgccatggagaaggcagcctttcagtataatggtaaaaaggaacttccagggaacatcttcaatggccacaaggagttggctacaaaaattaggctgtggcatcaacagggagaaaagtgcctctacactggcaaaaccatacccatcagcgacctgattcacaaccagtataagtacgagatcgaccatattcttcctctgtccttgtcttttgatgacagcctctcaaataaagtcctggtgcacgcgacagcaaaccaggaaaaggggcaacgcactccattccaggccttagatagtatggacgatgcttggtcctatcgggagtttaagagctacgtcaaagacctgaagtctctatcaaataaaaagaaagattacctcctgaccgaggaagacatcagtaagatagaggtgaagcagaaattcatcgaaagaaaccttgttgatacaaggtatagctcccgcgtggtattgaatgccctgcaggacttttacaagtctcaccaattcgataccactatttcggtcgtgcgaggacagtttacgagccagctccggcgtaaatggggtctggagaagtccagagagacatatcatcaccatgcagttgacgccttaatcattgctgcctcaagtcaactgaggctttggaaaaagcagaacaatccgttgatcacctacaaggaaggccagttcgtggattctcagactggggagataattagcctcaccgacgacgaatataaagagctggtcttcaaggcaccctacgatcactttgtggacacactacattccaaaaccttcgaagatggaatcctgttttcatatcaagtagacagcaagtacaaccgcaaaatttctgatgcgactatctacgctacacggaaggccaaactcgacaaggataagtccgaggagacgtatgtgctgggcaaaataaaggacatctacagtcaggcaggttatgatgccttcattaaaatctacaacaaggacaaaagaaagtttcttatgtatcacaaggatcctcagaccttcgaaaaagttattgaggaaatcttgaggacttacccaagcaaggagcgaaatgacaaaaacaaggaagtcccctgtaatccttttgagaaatatcgccaggagaacgggccaatacggaagtactctaagaaaggcaatggacccgaaattaagtgcctgaaatactatgataacaagttaggcaattacatcgacatctccccggacgggtcagataaccaagtggtgctccagagtctgaaaccttggagaacagacgtctatttcaatcaccagaccaaggagtacgaacttatgggactgaagtatagcgatttgtcgtttgagaaaggttccggcaagtactctattagcaacgaaaaatataattcaatcaagaggattgagggggttaacgagcagagtgagttcaaatttacactctacaagaatgacctgatactaatcaaggattccgaaaacaatgaacaaaaactgttccgttttaactctcgcaacgacactgctaagcattacgtggagctcaaaccctatgataaggcccggttcgacggacagcaggagctgattaccatccttggcaatgtggcaaaaggtgggcaatgtttgaagggcctgaacaaaagcaatatttccatcttcaaggtaaagacggatgtcttaggcaaaaagcacataatcaaaaaggaaggagacgagccaaaactcaagttttga

SEQ ID NO: 2791 - RNA, 3366 nt, synthetic construct
  misc_feature 1..3366: note = Cas9 variant
  source 1..3366: mol_type = other RNA
atggccgacaagaccctgggcgctctcacattcgggtttgatatcggaattgcaagcgtgggttggtgcgtccttggcgagaacagaatagttgacctgggggtgagggccttcgataaagcggaaactgctaaggagggagaatccttgaatttagcccggcgcacggcacgactgatgcgtagaaggctacggcgcagagcctggaggctcaccaaactggctcggcttctgaagcgcgagggcttgatcgcagacgcctttcagatgcaccaaccctctgctacatcaccttggaaactccgagtagaagccctggatagaaggctgactgacgatgagtgggcgcgggtgatttaccatctctgtaagcaccgtggtttccattggatcagtcgcgcagaggaaaagaaagccgagggggacgctaagggagaaagcggcagagtcaaaaagggcttatccgatacccagaggcggatgggggagaaaggatatcgatctgccgcagagatggtgctggctgaatttccagaggcccagcgcaacaagcagggtgactacggcaaggcgctttcgagagttttgctgtcagaagaactagccctcctgttcaggcggcaacgcgaacttgggcacacacatgcaagcaaagagctggaggctgccattttgggaaatggcgatagaaagggtgggctcttttgggctcagaaaccgcccctggccggagcagacttactgaagatgctcggcaaatgcaccttcgaaaaggatgagtatagggcccctaaagctagttttactgcggaacgtcacgtgtggcttacacggctgaacaatttgcgagtcgtggtagacggcaccacgagaccactaactgaggacgaaaggcgcgttgcactgcccctcccttacgggtatgccgatgctaagctgacctacaagcagcttcgggccgcactgtccaaagccggattgtctaacttcagctttgctggtatcgccgacgataaggagaaagacacactcactaagctgccagcatgggagaccttatccaaaacactgaagggcaaggggctagaaaccgagtgggaaggaatggcgggcgctgccacgggtggggatcccactctcctggacgagatatcaagagtgcttagtgtctataaagatggcgacgaagtggatgtggagttgaggaagctgcctctcccaggaggcgagaaaatggtcgaaacactgagcgagatctctttcgacaagtttcacgcactttccctgaaagccttgcgcaagattgttccgcatatggaaaccgggctccgatacgatgaggcttgtgccgcagctggataccaccattcacagctgcacgaggccggtgcgggcgggcaaaagtatttaccccctttctacactcggcgtgacaaagacggaagaatggtgttcgatgaggagctggacgtaccaaggaatcccgtggtcctacgcgccctcaaccaggctcggaaggtgctgaatgcacttgttagagcctatggcagccctagtgctgtgcacatcgaaatggccagggatttgtctaaaccactggtcggtcatcccacaccgaacgggggctacattgagggacgacgcgacatcgaaaagctccagaaagagtatcgggagagaaatgaaaaggataaggcagcgtttgccgctgagcacggcatagccgcaaaatccagggagttcgaaaagtttcagctgtaccgtgaacaacaggggaaatgcgcttatagcttaaagcctctggaccttcatcgcgtgttgcacgatattggatacgccgaggtagaccatgcactcccctactcgcggtcttatgatgacggtaaaaacaataaggttctggtgctaaccgaggaaaacagaaataaaggcaacaggacggcctacgagtatctgtgtgctttcccagggggagaaaacggcgagcgatggcggaattttgtcgcgtacgtggaatccaacaagtcatatcgcctcgccaagagaaccaggctgcttcggaaagatttcggtgggaaggcagctgaggagtttcgagaaagaaatttgaacgacacacgctacatctgcaaattctttaagaatttcgtcgagaggtttctgcagttaaaagtgggcgccgatggaactgccgctaagcgttgtgttgtgctcagtggccaaaccacagcattcctgcgggccagatgggggcttctgaaggtaaggggagcgagcgaccgccaccacgctttggacgccgcagtcgtggccgcttgctcccatggcatggttaaacgactcgcagattattctagaactaaggaactggccaaagtgcgggacggttttcctgatcccgagaccggggagattgtcgacccagcgatgttccagcagctacacgctcatttccccgatccttggccacactttaggggagaactggaggcccgcctccagctggacgatagcgcagaacttcgtgcccaattggagatgttcggcacatacccggctgaagccctggagaccttaagacccctctttgtgtcacgggcacctcagaggcgcaacggtggcgctgcccacaaggagactatctacgcgcagccagaacgactgaaagagcaagggggagtaacgcagaaggtgagtcttgcctccctgaagcccacagacatcgataaactaattgaccctcatagaaatgaaaagctctatgcagctatacgggccaggctggaggctcacggcgggaaaagcgataaggcattcccagccgacaaccccttgcgcaaaccggatagagacggaaatcctaccggcccaatcgttagggccgtcactatggtgattgacaagctgtctggtatccagatacgtgggggaattgctaagaacgataccatgttacgggtggacgtctttcgccataaaaaggatggcaaattccacctcgttcccctgtacgtgcatcacgcggtggcacaggaacttcctaatcgagccatcgtagcttttaaggacgaggatgagtggacactgatcgacgataacttccactttttgttctcatttcatcccaatgacttcattagaatcacccagaaaaacaaggccccaattctcggttattacgcaagttgtcacaggggcactgggaatctgaacctatgggcccatgatcggaaccaaaaagtcggaaaggacggccagatagaagggatcggagtgaagacagctgttgcgctggagaaatttcacgtggatgtccttggcaatatttatcctgcacccccagaacagcgccatggtctcgcctga

SEQ ID NO: 2792 - RNA, 3366 nt, synthetic construct
  misc_feature 1..3366: note = Cas9 variant
  source 1..3366: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggcgcgtgagactgaataggctatttgaggaatcaggcctcattacggacttcaccaagatcagtataaacctgaatccttaccagcttcgggtcaaaggtctgacagatgagttgagcaacgaagaactctttatcgccctgaagaatatggtgaagcaccgcgggatttcctatctggacgatgcgtctgacgatggaaactcgtcagttggcgactacgctcagatcgtgaaagagaatagcaagcagctcgaaactaaaaccccaggccaaattcagttagagcgatatcagacatacgggcagctgagaggagatttcaccgtcgaaaaggacggtaaaaagcataggcttatcaacgtgtttccgactagcgcctatcggtccgaggcattgcgtatactgcaaacacagcaggagttcaatccccagattaccgatgaatttatcaaccgctacctagagattctcacgggcaagagaaaatattaccacgggcctggaaatgaaaagtctaggactgactacggccggtatcgaaccagcggtgagacactggataacatcttcgggatccttattggaaaatgcactttttacccagacgagttccgcgccgctaaggcatcctataccgcccaagagtttaacctgttgaatgacctcaacaatctgacagtacccaccgagacgaaaaagttatcaaaagaacagaagaaccagataatcaattacgttaagaacgagaaagctatgggccctgccaagctgttcaaatatattgcgaagctccttagttgtgatgtggcagacatcaaaggctacagaatagataagagcgggaaggccgaaattcatacttttgaggcttataggaaaatgaagacactggaaaccttggacatcgagcaaatggatcgggagactctagacaaactggcctacgtcctcacactgaataccgaacgcgagggaatccaggaagcacttgagcacgagttcgctgatggttctttctcccagaaacaggtggacgaactggtgcaatttagaaaagccaactcaagcattttcggcaaggggtggcacaattttagtgtcaagttgatgatggagctcatcccagaactgtacgagacgtctgaggaacagatgaccattttaacaaggctgggaaaacagaagactacctccagctcgaacaaaacaaagtatatagatgagaaactactcactgaagagatctacaatcccgttgtggcgaagtctgtacgtcaggccattaagatcgtgaacgcagctatcaaagaatatggcgacttcgataatattgtcatagagatggcccgggaaaccaacgaggacgacgagaagaaagctatccaaaagattcagaaagccaataaggatgaaaaagacgcagccatgctgaaggctgcgaaccagtacaacggtaaggcagagcttcctcattccgtgtttcacgggcataaacagttggccacaaagatccgactgtggcaccaacagggcgaaagatgcctctataccggaaaaactatttcaatccacgatctgataaataacagtaatcagttcgaggttgaccatatccttccactgagcattacgtttgatgactccttggctaacaaggtgctcgtctacgccacagcaaatcaggaaaaaggccaaaggaccccgtatcaggccctggattctatggacgatgcttggagcttccgcgagttaaaggcctttgtgcgggagtcaaagactctgagtaacaaaaagaaagaatacctactcaccgaggaagacatctccaagttcgatgtaagaaagaagtttattgagaggaatctggttgacacacgctacgcaagccgagtggtccttaacgcgttgcaggaacacttccgggctcataagatcgataccaaagtgtctgtcgtgcgtgggcaatttacttcacagctgagaaggcactggggaatagagaagacacgcgacacgtatcatcaccacgccgttgacgcactcattatcgccgctagtagccagctgaatttatggaaaaagcagaaaaacaccctggtgtcctactctgaggatcaacttttggacattgaaactggtgagctcatctcggatgacgaatataaggagagcgtattcaaggccccctaccagcatttcgtcgatacactgaaatccaaggagtttgaagactcaatactattcagttatcaggtggattctaaatttaatcggaagatcagcgacgcaaccatttacgctacaagacaggccaaagttggcaaggataaagcggacgagacttatgtgctggggaagatcaaggatatttacacccaagacggatacgatgccttcatgaaaatctataagaaagacaagtccaaatttctcatgtacaggcacgaccctcagacgttcgaaaaggtcatagagccaattctggaaaactatcccaataagcagatcaacgagaaaggcaaggaggtgccttgtaatccatttcttaaatacaaggaggaacatggttatatccgaaaatactcaaagaaggggaacggccccgaaattaaaagtttgaagtattacgattctaaactgggaaaccacatcgacattaccccgaaggattccaataacaaagtagtgttacagagtgttagcccttggcgcgctgacgtctacttcaataagacaactggcaagtatgagatactcgggctgaaatacgcagatcttcaatttgaaaagggaaccggtacatataaaatctctcaggagaagtacaacgacattaaaaagaaggagggcgtggattccgactcagagttcaaatttactctgtataagaatgatttgctcctggtgaaagacaccgaaacgaaggaacagcaactattccggtttctgagtagaacaatgcccaaacagaagcactacgtcgagctcaaaccatatgataagcagaagttcgaagggggagaggccctgatcaaagttcttggcaacgtggctaatagcggtcagtgcaagaaagggttgggcaagtcgaacatttccatctacaaagtgaggaccgacgtactgggaaatcaacatataatcaagaacgagggcgacaagcctaaattagatttctga

SEQ ID NO: 2793 - RNA, 3366 nt, synthetic construct
  misc_feature 1..3366: note = Cas9 variant
  source 1..3366: mol_type = other RNA
atgaacggcctggtgctcgggcttgacatcggaattggtagcgtcggcgttgggatactgaataaggataccggagagatcattcacgccaactccagaatcttccccgctgcaacagccgacaataacgtggtaaggcggtcttcacgccagggccgacgtttgaatcataggaaaaagcacagaagtgtgcggttaaaagatctgtttgaatactatgacctactcactgatttcagcaaggtctccattaacctgaatccttaccgccttagagtggacggtctgaaccaacagttgacgaatgaggaactctttatcgcgctgaaaaacatagttaagaggcgggggatctcttatctggatgacgcttcggaggatggaggcgccgtgtcaagcgactacggcaaggcagtcgaagagaatcgcaaactcttagccgagcagaccccagggcagattcaactggaacgattcgagaagtatggacaggtgagaggtgattttacagtagttgaaaacggcgagaaaaggcggcttatcaatgtgttcagtacttccgcttacaagaaagaggcagaacgtattttgcgcaagcagcaggagtataacaatcaaatcatggacgaatttatagccgattacctgaccattctaacagggaagagaaaatactatcatggaccgggcaacgagaagtctaggaccgactacggtcggttccgaactgacgggacaaccctcgataacatctttggcattctgatcggaaaatgcacgttctatcccgaagagtaccgcgctagcaaggcctcctatactgcgcaggagtttaatcttctgaacgacttgaataacctcaccgtccctacagaaactaaaaagctgtcagaggaacagaaaaagaccatcgtggagtacgcaaagagtgccaaaacattaggcgctagcaccctgctcaagtatattgccaaaatgatagatgcatctgtggaccagatcagagggtacagggtcgatgttaataacaagccagaaatgcacacgttcgaggtgtaccggaaaatgcaacttctggagactattcccgtaggagaattttcccgcgaggtgttggacgaactagctcatatcctgacactcaataccgagagagaaggtatagaggaggccattaacactaagctgatggatgtcttctcacaggaccagatccttgaactggtgcaattcaggaagaataacagcagtttgttttctaaaggctggcacaatttctccctcaagctgatgatcgagttaattcctgaactgtatgagacaagcgaggaacagatggcgatcctaacccgtctcgggaaacagaagtttaaagagacgtcgaagcggaccaagtacattgatgaacaggaggttacagaagagatatataacccagtggtcgccaaatctgtgcgacaagcaatcaagattatcaatgaggctactaaaaagtacggaatcttcgacaacattgtaatagaaatggccagagagaataacgaagaggaagctaaaaaggattatatcaagaggcagaaagccaaccacgacgagaagaatgcagccatggagaaagctgcgtttcagtacaacggcgaaaaggagctgcccgactccattttccatggtcacaaagaacttgcaaccaaggttcgcttgtggcatcagcaaggggagaaatgtctgtatacaggcaagaatatccctatttcagatctcatccacaaccagtacaagtacgaaatagaccacatcctgccacttagtctgagctttgatgactccttgtctaataaagtgctcgtcctggccactgctaaccaggagaagggacggagaaccccgttccaggccttagatagcatggacgatgcatggtcatatagggagtttaaaagttacgtgaaggactccaaaagcctgggcaataagaagaaagattatctactcacagaagaggacatttctaagatcgaagtcaaacaaaagttcattgagcgcaacctggtggatacccgatactcaagtcgggttgtgcttaatactttgcaggacttttataaagcccataagttcgatacgacaatcagcgtagtccgtgggcagtttacctcccagctgagaaggaagtggggactcgagaaatctcgcgaaacttaccaccatcacgctgtggacgccctgataattgcagcgtcgagccaattacggctgtggaagaaacagaacaatccccttatctcctataaggagggtcagttcgttgactcagaaaccggcgagattatcagtttgacagatgacgaatacaaagagctcgtgttcaaggctccttacgatcattttgtcgacaccctgagatctaagaaattcgaggatagcatactattttcctatcaagtggactcaaagttcaacaggaaaatcagcgatgccactatttacgcaacacgaaaggccaaactggacaaggataaatctgaagagacgtatgtactcgggaagatcaaggacatttactcccagagtggatatgatgcttttatcaaaatatacaataaggacaaaagcaagttcctgatgtatcacaaagatccacagacctttgaaaaggtgattgaggaaatccttcgcacttacccctctaaggagttcaacgagaaaaataaggaagtttcctgcaacccttttgagaaatacaagcaggaaaacggcccaatccggaaatattcaaagaagggtaatgggcccgagattaaaagtttgaagtactatgacaaaaacatcccggagagcttcattaatataacaccttcgaactccaagaataaagtcatcctgagacaattaaacccctggaggaccgacgtgtactttaatcaccagacagagaagtatgagctcctgggccttaagtacgccgatctgcagttcgagaaaaagactggaacctattctattacgatcgacaaatacaacgaaattaaggaaaaagagggcgtgagcgagcattcagaatttaagttcaccttgtacaagaatgatctcctgctaatcaaagacacagagataaaggaagaacagatcttccgttttctgagtcgcactatgccaaaccaaaaacactatgtcgaactcaagccttactataaagggaatttcgagggaaaggagcggattaaagtttttaacaccacatccaatggtagatgtctgaagggccttaggaagaaagggttgtctatctacaagattaaaactgatgtgctgggaaacaagcatttcatcaaaaaggaaggcgagaagcccaaattaaagttttga

SEQ ID NO: 2794 - RNA, 3369 nt, synthetic construct
  misc_feature 1..3369: note = Cas9 variant
  source 1..3369: mol_type = other RNA
atgaacggcaagatcctggggctcgacattggagtggccagcgtcggtgttggcatacttgataaaaagaccggggaaatcattcacgcttcctctagaatcttccccgcagccacagcggactcaaatgtggaaaggcggggatttcgccagggccgacgtctgggtagaaggaaaaagcatcggaaagtacgcttggctgatttattcagtgacactgggctgattacggattttagcaaggtgtccatcaacctaaatccttacgagctcagaataaagggactgaacgaaaaacttaccaatgaggaactgttcatcgccttgaagaacattgtcaaaaggcggggcatctcttatctcgacgatgcaaatgaggacggcgagtcgtcaagcagtgaatacgggaaggccgtggaggaaaaccgcaaactgctggctgataagacaccaggacaaattcagctcgagcgatttgagaagtatggtcaggttagaggcgacttcactatcgaagagaatggggaaaaacacaggttactgaacgtgttttccacctctgcatacaagaaagaggccgaacggatacttacaaagcagcaagattataatcaggacattaccgatgagttcatccaggcttacttgactattctgacaggaaaacgtaagtattaccatggcccgggtaacgagaaaagccgcaccgactacgggagatttaggacggacggaactaccctagataatatcttcggcatcctcattggcaagtgcacattttatcccgaagagtaccgggccgcgaaggcatcctatactgcccaggagttcaacctgcttaatgacctgaacaacttgaccgtccctacagagaccaaaaagctctcagaagaacaaaaacgacagataatcgagtacgctaagggggccaaaacgctgggagcagctactttactgaagtatattgccaagctcgtggatggtagtgtagaagacatcaaaggctaccgcatagataagagcgagaaaccagaaatgcacacatttgacatttatagaaagatgcagacccttgagactgttgatgtggaaaaactgtctagggaggtcttggacgagctagcgcatatcctgacactcaataccgaacgggaggggatcgaagaggccattaaggtgtccttcatcaagcgcgagttcgaacaggatcaaattgcagagctggtgtcatttagaaaaagcaacagttctcttttcggaaagggctggcacaatttttccataaaactgatgacggaattgatccccgagctctacgaaaccagcgaggagcagatgacaattctgactaggttaggtaagcagaaaaccaaggctcgttcgaagcggacaaaatacatcgacgaaaaggagctgactgatgaaatctataaccctgtcgttgccaaatctgtgcgacaagctattaagataatcaatctagccaccaaaaagtacggggtattcgacaacattgtgatcgagatggcaagagaaaataacgaggaggacgccaaaaaggattatgtcaagaggcagaaagctaatgaagacgagaagaacgcggcaatggaaaaagccgctcaccagtacaatggcaagaaagagctcccagataacgtgtttcatggacacaaggaactggccacaaagattcgcctttggcatcagcaaggcgagaaatgtttgtataccgggaagaatatccccatatccgacctgatccacaaccagtacaaatatgagattgatcacatcctccctctgtcacttagtttcgacgatagcctggcaaataaggttttggtgctcgccactgctaaccaggaaaaaggacagcggacgccatttcaagccctggactccatggatgacgcatggtcttacagagagttcaaggcgtacgtcaggggtgctcgcgccttaagcaacaagaaaaaggattatctgctaaatgaagaggacattaacaaaatcgaggtgaagcagaaatttatagaacgaaatctcgtagatacacggtactcaagtcgtgttgtgctgaacgcacttcaggacttctataagttgaatgactttgataccaagatttccgtcgtgagaggccagttcactagccaactgaggcgcaaatggcggatcgacaagtctagagagacctaccatcaccatgccgtcgatgctctcattatcgccgcatcaagtcagctgaggttatggaaaaagcaggggaacccgctgataagctataaagaaaatcagtttgtggactccgagacaggagaaatcatttctcttaccgatgacgagtacaaggagttggttttccgagctccctatgatcacttcgtggacactgtatcgagcaaaaagtttgaagatcgcatcctcttctcctaccaagtcgactcaaagtacaaccggaaaattagtgatgccacaatctattctacgagaaaggcgaaactgggcaaggacaaaagcgaggaaacctacgtgctaggtaagataaaggatatttatactcagacagggtacgacgcctttatcaaactgtataagaaagacaagtccaaattcctcatgtaccataaggatcctatcacctttgagaaggttattgaagagatcctgaaaacatatccagacaaggagattaatgaaaaaggcaaggaggtggcttgcaaccccttcgaaaaatacaggcaggagaatggacctcttcgtaagtactcaaagaaaggcaaggggccagaaataaagagcttgaagtattacgataacaaactgggaaatcacatcgacattactcccgataactctgagaatcaagtcatcttacagtccctcaagccgtggcgcaccgacgtgtattttaaccacaagacgaaaatttacgagctgatgggtcttaagtatagtgatctgagcttcgaaaaaggctctgggaagtaccggatctccttggacaaatataacgtaataaagaaaaaggagggagtgcataaggaatcagagtttaaattcaccctctacaagaatgatctgatcctaattaaagacctggagaagagtgaacagcagctctttagatacaacagcaggaatgatacatcgaaacactatgttgagctgaagccttacgacaaggcaaaattcgaaggcaaccaaccccttatggccttgtttggtaatgtcgctaaagggggccagtgtctgaaaggattaaacaaggccaatatctccatttataaagtgcagactgacgtgctcggcaacaagcgattcatcaagaaagagggggatgcaccaaagctggagttctga

SEQ ID NO: 2795 - RNA, 3369 nt, synthetic construct
  misc_feature 1..3369: note = Cas9 variant
  source 1..3369: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggtaaggcggacaaaccgccaaggacgacgtttaactagaaggaagaaacatcggattgtgcgcctgaatagactatttgaggaatcaggcctcatcacggacttcaccaagataagtatcaacctgaatccttaccagcttagggtcaaaggtctgacagatgagttgagcaacgaagaactctttattgccctgaagaatatggtgaagcaccgggggatctcctatctggacgatgcgtctgacgatggaaactcgtcagttggcgactacgctcagattgtgaaagagaatagcaagcagctcgaaactaaaaccccaggccaaatccagttagagcgctatcagacatacgggcagctgcgaggagatttcaccgtcgaaaaggacggtaaaaagcatagacttataaacgtgtttccgacaagtgcctataggtccgaggcattgcggattctgcaaactcagcaggagttcaattctcagatcaccgatgaatttattaaccgttacctagagatcctcacgggcaagcgcaaatattaccacgggcccggaaatgaaaagagcagaactgactacggcaggtatcggaccaacggtgagacactggataacatcttcgggattcttataggaaaatgcactttttaccctgacgagttccgagccgctaaggcatcctataccgcccaagagtttaatctgttgaacgacctcaataacctgacagtaccaaccgagacgaaaaagttatcaaaagaacagaagaatcagatcattaactacgttaagaatgagaaagtgatgggccccgctaagctgttcaaatatatcgccaagctccttagttgtgatgtcgcggacataaaaggccatcgcattgataagagcgggaaggcagaaatccacacttttgaggcctacagaaaaatgaagacactggaaaccttggacatcgagcaaatggatagggagactctagacaaactggcttatgtgctcacactgaacaccgaacgggagggtattcaggaagcccttgagcacgagttcgcagatggatctttctcccagaaacaggtggacgaactggtccaatttcgcaaggctaattcaagcatcttcggcaaggggtggcataactttagtgttaagttgatgatggagctcattcctgaactgtacgagacgtctgaggaacagatgaccatattaacaagactgggaaaacagaagactacctccagctcgaataaaacaaagtacatcgatgagaaactactcactgaagagatttataacccagtggtagccaagtctgtgaggcaggcgatcaagatcgtcaatgccgcaattaaagaatacggcgacttcgataacatagtgatcgagatggctcgtgaaaccaatgaggacgacgagaagaaagccattcaaaagatccagaaagctaacaaggatgaaaaagacgccgcaatgctgaaggccgctaaccagtataatggtaaggcggagcttccccactccgtttttcatgggcacaaacagttggcaacaaagattcggctgtggcaccaacagggcgaacgatgcctctacaccggaaaaactatctcaatacatgatctgatcaacaatcctaaccagttcgaggtggaccacattcttccactgagtatcacgtttgatgacagcttggccaataaggtcctcgtgtatgctacagccaaccaggaaaaaggccaaagaaccccgtaccaggcactggattccatggacgatgcctggtctttcagggagttaaaggcttttgtacgcgagagcaagactctgtcaaataaaaagaaagaatatctactcaccgaggaagacattagtaagttcgatgttcggaaaaagtttatcgagagaaacctggtggacacaaggtacgcctcccgcgtcgtgcttaatgcattgcaggaacatttccgagcgcacaagatagataccaaagtcagcgtggttcgggggcaatttacttctcagctgcgtagacattggggaattgagaagacaagggacacgtaccaccaccatgctgtggacgccctcatcattgcagcctcaagtcagctgaacttatggaaaaagcagaaaaataccctggtaagctattccgaggaacaacttttggatatcgagactggtgaactcatatctgacgatgagtacaaggagtcggtcttcaaggctccctatcagcacttcgtggacacactgaaaagcaaggaatttgaggattccatcctattctcataccaggttgacagtaaatttaaccgcaagatttctgatgccaccatctatgcaacacggcaggctaaagtgggcaaggacaaaaaggatgaaacttacgtcctggggaagattaaagacatctatacccaagatggatacgacgccttcatgaagatatacaaaaaggataaaagcaagtttctcatgtatagacatgaccctcagacgttcgagaaggtgattgaaccaatcctggagaattaccccaacaaagagatgaatgaaaagggcaaagaggtaccttgtaacccatttcttaagtataaagaggaacacggttacatcaggaagtattccaagaaagggaacggccccgaaattaagtcattgaaatactatgacagcaagctgttaggaaatccgatcgatattacccctgagaactctaaaaataaggtggttctccagtccctgaagccctggcgaacagacgtctacttcaacaaaaatactggcaagtacgagatacttgggctgaaatatgcggatttgcagtttgaaaagaaaaccggaacatacaagatcagtcaagagaagtataacggtattatgaaagaagagggcgtggacagcgattctgagttcaagtttactctctacaaaaatgacctgctactggtgaaggataccgaaacgaaagagcagcaactcttccgctttctgtcccggacaatgccaaacgtcaagtattacgttgaacttaaaccttattcaaaggacaagttcgagaaaaatgaaagtttgatcgagattctggggagcgccgataagtcgggaagatgcatcaaaggcttaggtaagtccaacatatctatctacaaagtgaggaccgacgtgctcgggaatcagcacattatcaagaacgagggcgataagcccaaactggacttctga

SEQ ID NO: 2796 - RNA, 3369 nt, synthetic construct
  misc_feature 1..3369: note = Cas9 variant
  source 1..3369: mol_type = other RNA
atgagcaacggcaagatcctggggctcgacattggaatagcctccgtgggtgtcggcgttatcgatgctcagaccggggagattatccacgcatcttcaagaattttccccagtgccaatgcggctaacaatgccgaaaggcggacatttcgcggaagccgacgtcttatcagaaggaaaaagcatcggataaaacgcctggacgatttgttcaacgactttcacatcaatttagatggcgagatgtccactgacaacccttacgtgctgagagtaaagggtctatctcaaaaactcacggtggaagaactgtatatttcgatcaagaatattatgaagaggcgggggatctcataccttgatgacgcagaaagcgataacgaggccggacgcagtgactatgctaaagcaatagagcgaaatagacagctgttgacctccaagacaccaggcgaaattcagctcgagaggctggaaaaatacggccagctgcgggggaacttcactatcattgatgaggagggacaatctcagcagatcatcaatgtctttagcacctccgactatgtgaaggaagttgagaaaattctcgattgccagaagatgtaccataagttcatatcagacgaattttgtgacaaattaatcgagctgcttcgtgaaaagcgcaaatattacgtgggtccgggcaacgagaagagtagaacagattacgggatttataggaccgacggaactacattggagaatctgttcggcatcctaataggtaaatgcaccttttaccccgatcaatatcggagctctcgagcctcctacacggctcaggagttcaactttctcaatgacctgaacaaccttactgtccctaccgagacaaagaaactgtcacaggaacagaaggagttcttggtgaattatgccaaggaaactagcgtactcggggcgggaaaaattctgcaacagatcgcaaagttagccgattgtaaagttgaggacatccgcggctacagactggataacaaggacaaaccagagctccacatttttgaaacctatagggctatgaagggccttgtgcccctggtcgatatcggggtgttgagtcgggagcagctagacattctggccgatatactcacactgaataccgacttcgaaggaatccgcgaggcacttaagaaacaactgcctaacgtgttcgacgaaaagcaggtcaaaggtttggcttcttttagaaagtccaaaagccaactcttcgccaagggctggcataatctgtcgcagaagattatgttagaggttatcccagagctgtacgcgacgtctgatgaacagatgactatcctaacaaggctcgggaaatttgagaagtcctcagtggccgaataccccagtagcattaacgtagacgagataaccgatgagatctataatcctgtggtcgcaaaatccattcgtcagactatcaagattatcaacgcttctatcaaaaagtggggagagttcgaccagatagtgattgagatgccacgggatcgaaatgaagacgaggaaaagaaaagaatcgccgatggccagaaggctaacgccaaagagaaggcagacagcattctgagggccgctgagctttactgcgcgggtaaagttttgccggattatgtgtacaatgggcacaaccaactggcaacaaagatccgcctctggtatcagcagggcgaacggtgtatatacaccggacagcccatttcaatccacgacctgattcataatcaaaaccagtatgagatcgatcacatacttcctctgagtttgacgtttgacgattccctcagcaataaagtcctggtgttagccaccgctaaccaggaaaaggcccagagaacaccatacaactacctgaagtctgcaacttcagcctggagttatagggagttcaaagactacgtaaccaagcgcaaaggcatcgggaagaaaaagtgcgaatatctaacatttgaggaggacattaatggattcgaagttcgaagcaagtttatccaacggaacctcgtggatactcgttacgcttccaaagtcattctgaatgcccttcaggactatttcaagatctctggtatacagaccaaagtgtcggtcgtgagaggccaatttacaagccagttgaggcataagtgggggattgagaaaacccgcgaaacttaccaccaccatgcagttgatgcgctgatcatcgctgcctcctcacagctccggctgtggaagaagcaggagagtcccttagtggtagactatcaagaaggaagacaggtcgatctggagacgggcgagattcttgaattgacagacgagcagtacaaagaactcgtgtaccagcctccatatcaaggtttcgttaacaccatctctagctccgcatttgataatgagattctgttctcataccaggtggacagcaaggtcaacaggaaaatatctgatgccactatctatgctacccgaaatgcccagctagggaaggacaaaacagagggcatttacgtgctgggaaagatcaaggatatttatacccaggcaggctacgaggctttcctcaaacgctatactaaggacaaaacatcctttctgatgtaccacaaggatcttgacacgtgggaaaaagtaatcgaaataatcttgcgggactacagagagtatgatgaaaaggggaaagagattggaaaccccttcgagaggtaccgtcgcgaaaatggttatgtgaagaagtacagtcggaaaggcaacgggaccgccatcaagagcctgaaatattacgacaataagttaggaaaccatattgatatcactccggaaaattctagaaacgcggttgtcctccaatccctgaaaccttggaggacagacgtgtattttaataaggaaaccggcaagtacgagttccttggtataaaatactcagatctgagttttgaaaaggggacaggcgagtatggaattagccaggagaaatacgactcgatcaagatcgccgaaggcgtggctaaaaagtccattttcaagtttactttgtataaacaggatctcctgttcataaaggacatcgagaacaactttgggaaactactgcgattcacctctaagaatgatacgagcaaacactacgtcgaactcaagccctatgacaagaacaaatttggaaccgaggaaccactgcttcctgttttgggcaatgtggcaaagtcaggtcaatgtattaaagggctgaacaagagtaatatctccatttacaaagtgcggacagatatcttaggatatcgccatttcataaagcaggagggcgagcacccccagctcaagtttaaaaagtga

SEQ ID NO: 2797 - RNA, 3369 nt, synthetic construct
  misc_feature 1..3369: note = Cas9 variant
  source 1..3369: mol_type = other RNA
atgagcaacggcaagatcctggggctcgacattggaatagcctccgtgggtgtcggcgttatcgatgctcagaccggggagattatccacgcatcttcaagaattttccccagtgccaatgcggctaacaatgccgaaaggcggacatttcgcggaagccgacgtcttatcagaaggaaaaagcatcggataaaacgcctggacgatttgttcaacgactttcacatcaatttagatggcgagatgtccactgacaacccttacgtgctgagagtaaagggtctatctcaaaaactcacggtggaagaactgtatatttcgatcaagaatattatgaagaggcgggggatctcataccttgatgacgcagaaagcgataacgaggccggacgcagtgactatgctaaagcaatagagcgaaatagacagctgttgacctccaagacaccaggcgaaattcagctcgagaggctggaaaaatacggccagctgcgggggaacttcactatcattgatgaggagggacaatctcagcagatcatcaatgtctttagcacctccgactatgtgaaggaagttgagaaaattctcgattgccagaagatgtaccataagttcatatcagacgaattttgtgacaaattaatcgagctgcttcgtgaaaagcgcaaatattacgtgggtccgggcaacgagaagagtagaacagattacgggatttataggaccgacggaactacattggagaatctgttcggcatcctaataggtaaatgcaccttttaccccgatcaatatcggagctctcgagcctcctacacggctcaggagttcaactttctcaatgacctgaacaaccttactgtccctaccgagacaaagaaactgtcacaggaacagaaggagttcttggtgaattatgccaaggaaactagcgtactcggggcgggaaaaattctgcaacagatcgcaaagttagccgattgtaaagttgaggacatccgcggctacagactggataacaaggacaaaccagagctccacacctttgaaacatatagggctatgaagggccttgtgcccctggtcgatattggggtgttgagtcgggagcagctagacatcctggccgatattctcaccctgaatacggacttcgaaggaatacgcgaggcacttaagaaacaactgcctaacgtgttcgacgaaaagcaggtcaaaggtttggcttcttttagaaagtccaaaagccaactcttcgccaagggctggcataatctgtcgcagaagatcatgttagaggttattccagagctgtacgcgacttctgatgaacagatgacaatcctaaccaggctcgggaaatttgagaagtcctcagtggccgaataccccagtagcatcaacgtagacgagattactgatgagatatataatcctgtggtcgcaaaatccatccgtcagacaattaagatcattaacgcttctatcaaaaagtggggagagttcgaccagatagtgatcgagatgccacgggatcgaaatgaagacgaggaaaagaaaagaattgccgatggccagaaggctaacgccaaagagaaggcagacagcatcctgagggccgctgagctttactgcgcgggtaaagttttgccggattatgtgtacaatgggcacaaccaactggcaaccaagattcgcctctggtatcagcagggcgaacggtgtatctacacgggacagcccatatcaattcacgacctgatccataatcaaaaccagtatgagattgatcacatccttcctctgagtttgacctttgacgattccctcagcaataaagtcctggtgttagccacagctaaccaggaaaaggcccagagaactccatacaactacctgaagtctgcaacctcagcctggagttatagggagttcaaagactacgtaacaaagcgcaaaggcatagggaagaaaaagtgcgaatatctaacttttgaggaggacatcaatggattcgaagttcgaagcaagtttattcaacggaacctcgtggatacccgttacgcttccaaagtcatcctgaatgcccttcaggactatttcaagatttctggtatccagacaaaagtgtcggtcgtgagaggccaatttaccagccagttgaggcataagtgggggatagagaaaactcgcgaaacgtaccaccaccatgcagttgatgcgctgattatcgctgcctcctcacagctccggctgtggaagaagcaggagagtcccttagtggtagactatcaagaaggaagacaggtcgatctggagacaggcgagatccttgaattgaccgacgagcagtacaaagaactcgtgtaccagcctccatatcaaggtttcgttaacactatttctagctccgcatttgataatgagatcctgttctcataccaggtggacagcaaggtcaacaggaaaatttctgatgccaccatatatgctacacgaaatgcccagctagggaaggacaaaaccgagggcatctacgtgctgggaaagattaaggatatctatactcaggcaggctacgaggctttcctcaaacgctatacaaaggacaaaacgtcctttctgatgtaccacaaggatcttgacacctgggaaaaagtaattgaaatcatattgcgggactacagagagtatgatgaaaaggggaaagagatcggaaaccccttcgagaggtaccgtcgcgaaaatggttatgtgaagaagtacagtcggaaaggcaacgggactgccattaagagcctgaaatattacgacaataagttaggaaaccatatcgatattacaccggaaaattctagaaacgcggttgtcctccaatccctgaaaccttggaggaccgacgtgtattttaataaggaaacaggcaagtacgagttccttggtatcaaatactcagatctgagttttgaaaaggggactggcgagtatggaataagccaggagaaatacgactcgattaagatcgccgaaggcgtggctaaaaagtccatcttcaagtttaccttgtataaacaggatctcctgttcattaaggacatagagaacaactttgggaaactactgcgattcacgtctaagaatgataccagcaaacactacgtcgaactcaagccctatgacaagaacaaatttggaacagaggaaccactgcttcctgttttgggcaatgtggcaaagtcaggtcaatgtatcaaagggctgaacaagagtaatatttccatctacaaagtgcggactgatattttaggatatcgccatttcatcaagcaggagggcgagcacccccagctcaagtttaaaaagtga

SEQ ID NO: 2798 - RNA, 3372 nt, synthetic construct
  misc_feature 1..3372: note = Cas9 variant
  source 1..3372: mol_type = other RNA
atggccaagatcctgggcctcgaccttgggaccaacagcattggatgggctctgatagatgacgtgcagaataaaatcttgggtgtcggctccagaattttccccatgggggttgagaacttaggagatggcgacggtgaaatctctaagaatgcatcaaggacagggactcggggagtgcgccgacaatttttccgtagaaggctgcggaaaaaggtactactcaaagccctgagtgagaacaatatgtgccctatgattacgagcgattttgacaactggaagaagaccaaacagttcccatccgaaaaacttgcgtcttggtttgctctgaatccgtacgagttgcgcaacaaagccctctcggaaaagctgacactggaggagatcggcagaatattctatcacctcatccagaggcggggctttttatcaaatagccgcaaagggggaactgatgacggtgcaattttcaagggcaaccccaaggaagggaaaatcggaattaccgatacacaggagagtatccaagacaagaccctgggctcctacctttttgaaatatatcctaaagagaatcagccattccagaacggtttggagcgaattagaaataggtacactgtgcggaagatgtatgtcgatgaatttgagatgatctgggaaaaacaggcccaatactattctaacctgaatgaggacctaaagacactcttcgggggacgtaaactggatggctacaaggaagacggcattctttttcatcagcgccccctgagaagccagaagcacttggtggggaactgtgttttcgagcctaacaaaaccaagtgcccaatctccgctatccccttcgagcagtttagggtgtggcaatgggtcaatacggtggaatacaacggaaagaagatttcacaggtagagaaagaaaagatagttgagttcctctatgcaaatgacaagactgattttaaaaagatccggaaagccattggtaaggaaagtaccgagttcaaatttaactacaaggacgatgacaagatcgtgggcacatatactgtcagccatctgtctaataaaaagtacttcgggaaaaagtggtttgagttctccgaaaaagagcaggaagatatatggcacattttatactttttcgactcaaagagcaacctgaaggagtatgctatcaaaaattggaactttaccgaggaacaagccgagagtatcgcgaagttcaatgtgaaagatggatattcttccctcagccgaaaggcaatttcgaacatccttccttttctgaaattgggcttcacatacgacgtggccgtcgttctaggtgggattaagaatgtgttcggccatgaatgggagaaactgtctgatgaaaagcgcaactttctcatagacaatgtagagggaatcgtgagatccaagaccaaaggcgggttcattgatgtcatcaaggacatcctgaggaacgactacaatatttcagataaccagcttcggaaactgtatcaccacagtgctacgatatacgtggccgagttgctcgaaaagctgccagttggaaaagaggcagacaaggaaatccagagcattcgcaacccgatcgtgattactgctttatttgagctgagaaagctagtcaatgaactcatcgatgacttcggttccatagatgagatcaaagtggagatggccagggacctgaagatttctaaaagccagcgtaacaagatccggcgagaacaaaagagacttgagagggaaaatgatcgcgtaaaggcgcggttgctggaggaaggccagagaattacacatgacaacatcctcctgtataaactttgggaggagtgtaaaaagacctgcccctacactgggaatcctataccactgtataaattgtttacaggagaaattcagatcgagcacattcatccctggtcaaggagtctcaacgattccttcgccaataagaccctgtgttacgcagacgaaaaccgcaaaaagggcgataagacgccttatgagttttacggtaatgacgaaagcaactggtctgctatcaaagagcgagccttaaagctgttctcagataccaaagagtacccaaatgcttatcagaagtttaaacggttcgttcaacacaagtttgacgacgatttcagtagccgtcagctaaacgacacaagatacatatccaaagaagccaagaattatctctctaagatctgcaaaaaggtggcagtctcgcccgggcaggccactagcaacctgaggcagaaatggggcatgaataacattcttaacgatgagaatgaaaagacccgcgaggaccaccggcatcacgctatcgatgcgttggtgatggcatgtacaaaaatttcctacgtccaagagctgtcaaagtggaacagatataataggaacgccgaactcaagaaatttccgctgccttgggagactttctggagtgacgctaatcgagccgtggataagatcttaatatctcataaaaaggttagcaacgacattaccggacgcacacacatctccgagaaaaatggcaagaagtacaaaaacgtgggggtagcagcccggggacagctgcataaggaaaccgtctatggtaaaagaactttcaatggcgaagaggcttttcacgtgaggaagacgatcgattcacttacaaccgagaaacagttggaaaaggttgtggacgagagcattaagctcctgatcaaaaagcgtgtccaggaactagggggattcgtgaaaggcgccattcccgcaaacacctttttcgtagtggatgagaatggtataaagcaaccacagatctttctgcctaacaaaaatggggcgcccgttccagtcctcaaggtgcgcatgaaggaaaacattggcggagctgagaaactgaaggagaatgtgaaccagtgggtcaacccccggaataaccaccatgttcttatctacaaagacgaaaagggcaatttgaaagaggaagtggtgactttctggacagtagtcgagagaaagaggaccgggcaatctgcctaccagctgccttttgatggaaaagaaattgtgactacattacacatcaacgacatgttcctcctgggccttaatgaggaggaaataaactgggagaatccagactatgaagttctgaaggagcatttgtaccgagtgcagaagtttacgtccggtgattattacttccggatcgcaaaaaccagtagcattcagaacgccatcgagaagcaacagattaattcttttgggttcggcaaaaacggatggtccactcacaatccgatcaaggtcaaaatatcagtgagtggtaagattagcaaggtttga

SEQ ID NO: 2799 - RNA, 3372 nt, synthetic construct
  misc_feature 1..3372: note = Cas9 variant
  source 1..3372: mol_type = other RNA
atgaacggcctggtgctcgggcttgacatcggaattggtagcgtcggcgttgggatactgaataaggataccggagagatcattcacacaaactccagaatcttccccgccgctactgcagacaataacgtggaaaggcggaatagtcgccaggcccgacgtttgaacagaaggaaaaagcatcggggcgcgcgcttacacgatctgtttgaggactacgatctactcattgacttctcaaaagtaagtatcaatctgaacccttatagacttagggtgcaaggtctggataatccattgacgaccgaagaactctttatagctctgaagaacatcgtcaaacggcgcgggattagctacctggacgatgcctccgaaaatggaggcgcagtgtcttcggactatggcaaggccgttgaggagaaccgaaagctcttagctgaacagacaccggggcagatccagctggagagattcgaaaaatacggacaagtgaggggtgattttactgtcgaggagaagggcgacaaacatcggcttattaatgtgttctcaaccagcgcatatcgtaaggaagccgagcgcatcttgagaaaacagcaggaatttaacaatcagataacagataagttcattgaggactacctgaagatcctaaccgagaaaaggaagtattaccacgggcccggaaacgagaaaagtcggactgactacggccgatttcgcacagatggtaccacgctcgacaacattttcgggatcctgatcggaaagtgcactttttatcctaatgagtacagagcttccaaagcctcttataccgcgcaagagttcaaccttctgaatgatttgaacaatctcacagtaccaactgagaccaagaaactgagcgaggaacagaagaagacaattgttgaatacgcaaaatccgccaagaccttaggcgcttcaacgctgctcaaatatatagccaagatgatcgacgcaagtgtggatcagattaggggctaccgggtcgacgtgaacaataaacccgagatgcatacttttgaggtgtatcgcaagatgcagagccttgaaacaatccctgtcggggagttctctagagaagttctggatgagttggctcacatactaaccctgaacactgaaagggagggaattgaggaagccatcaatacaaagctcatggacgtgttctcccaagatcagatcctggagcttgtacagtttcgtaaaaacaattcaagcctgttcagtaagggttggcacaacttttctttgaaactcatgatggaactgattccagagttatacgagacctccgaggaacaaatggcgatcctgacgcggctaggcaagcagaaattcaaggaaaccagcaagcgaacaaaatacattgacgagaaggaagtgactgaggagatatataatcccgtcgtggccaaatcggttagacaggcaatcaagattatcaacgaagctaccaaaaagtacgggatctttgataatattgtgatagagatggccagggaaaacaacgaggaagacgctaagaaagactatatcaagcgccagaaagccaatcatgatgagaagaacgcagccatggagaaagctgcgttccaatacaatggaaagaaagaactccctgactctatttttcacggccataaggagctggcaacaaagatccggctttggcaccagcagggtgaaaaatgtttgtatactgggaagaacattccaatctccgatctgatacacaatcagtacaaatatgagatcgaccatattctcccgctgtcacttagtttcgatgacagcctgtccaacaaggtcttggtgctcgccaccgctaatcaagaaaaaggccagagaacaccctttcaggccctggattctatggacgatgcatggagctacagggagttcaagtcatacgtaaaggacagtaaattactgggaaacaagaaaaaggattatctactcaccgaggaagacatctccaaaattgaggttaagcagaagtttatcgaacgcaatctggtggatactcgatacagctctcgggtcgtgcttaacacgttgcaagacttctataaagcccacaagtttgacacaaccatatcagtcgtgcgtggccagttcacttctcagctgagaaggaaatgggggctcgaaaagagccgcgagacctaccatcaccatgctgttgatgccctgattatcgcagcgtcctctcagttacggctgtggaaaaagcaagctaatcctcttatttcgtataaggaagaccagttcgtggatagcgagacaggagaaatcatatccttgaccgacgataaatacaaggagctcgtatttaaagccccatatgcacacttcgtcgacactctgtcaagtaagaaatttgaagattctatcctattcagctaccaggtggactccaagtacaacagaaaaatttcagatgccacaatctatgctacgaggaaggttaagctggacaaagataagagcgaggagacctacgtgctcggtaaaattaaggacatctattctcaagccggctacgatgcatttataaaaatttataataaggacaagtccaaattcctgatgtaccacaaggacccccagacttttgaaaaagtcatcgaggaaatccttcgaacatatcctagtaaggagttcaacgagaaaaataaggaagtgccatgcaacccctttgagaagtaccgccaggaaaacgggccgattcggaaatacagcaagaaaggaaatggccctgagatcaagtctttgaaatattacgataagaacattcccgaatccttcataaatatcaccccatcaaacagtaagaataaagtaattctgagacagttaaacccttggaggacagacgtgtattttaatcatcaaactgagaagtacgaactcctgggtcttaaatatgctgatctgcagttcgagaagaaaaccgggacgtacagcatcaccattgacaagtataacgagatcaaggaaaaagagggcgttggagaacagtcggagtttaagttcacattgtacaaaaatgatctcctgctaataaaggacactaaaaacaatgagaagcagatcttccgttttctgtcccgcaccatgcccaacgtcaaacactacgtggaactcaagccatatgataaggccaaattcgacggcaatcaacccctgattacaatctttgggaacgtggcgaagggaggtcagtgtcttaaaggcttgaataagtctaacattagcatcttcaaagtcaagactgatgttctggggaacaagcattttataaccaaagagggagaaaagcctaaattaaagttctga

SEQ ID NO: 2800 - RNA, 3378 nt, synthetic construct
  misc_feature 1..3378: note = Cas9 variant
  source 1..3378: mol_type = other RNA
atgaacggcctggtgctcgggcttgacatcggaattgccagcgtcggtgttggcatactgaataaggagaccggggaaatcattcacgtgaactccagaatcttccccgctgcaacagccgattctaatgtagagaggcggggatttcgccagggccgacgtttgggtagaaggaaaaagcatcggtcagcgcgcttaaacgacctgttcgaagagtttgggttcattactgattttagtgctgtgcctctaaatctcaacccatacgccctgagagtcaaaggacttagcgaagaactgacgaatgaggaattgttcatcgcactcaagaacataatcaaaaggcggggcatttcctatctggacgatgcctctgaggacggcgaaaccgcttcgaatgagtacgggaaggcagtggaggaaaaccgcaagctgctcgccgataaaacaccgggacaaatccagttagagcgatttgaaaagtatggtcaggttagaggcgacttcactgtggtcgagaatggggaaaaccacaggctgattaatgtgttttcaaccagcgcttacaaaaaggaggccgagcggatccttcgtcgccagcaagagttcaacgtaagaataagtgatgagtttattgaagcgtatttgacaatcctgaccggaaaaaggaagtactatcatggccccggtaatgagaagtcccggactgactacgggcgattccgcacagatggaaccacgctagacaacatttttggcatcctcatcggcaaatgcactttctaccctgatgaatatagagcagccaaggcttcttacaccgcccaggagttcaacctgcttaatgacctgaacaatttgacagttccaactgagaccaaaaagctcaggcccgaacagaaacggcagattgtggagtatgcacgcacagctaagaccctggggacgcctactttactgaaatacatagccaagctcgtcgacggaagcatcgatgacattaagggttatagaatcgataaatccgacaagccagaaatgcacacatttgatgcgtacaggaaaatgcgtacccttgagctggtggacgtggatatattgtcacgggaaactctagacgatctggcctatattctcacactgaacaccgagagtgagggcatccttgaagcactgaatagcaagatgcccgggacgttcaccaaagagcaaatcgacgaattgattcagtttcgaaagaagaactctgctgtcttcggaaaaggctggcataatttttccctcaagctgatgaacgagttaatccctgagctgtacgaaacatcagaggaacagatgactattctaaccagactcggtaaacagaggagccgcgagataagtaagcggacaaaatacatcgatgaaaaggagctgactgacgagatttataatccagttgtggccaagtctgtaagacaagctatcaaaatcattaaccttgccaccaagaaatacgggatattcgacaatatcgtgattgaaatggcaagggagtccaacgaagatgacgagaagaaagccatccagaatgtccagaaggctaacgaagatgagaagaaagcggcaatggagaaggccgctgacttgtataatggcaaaaaggaactgccggatagcatttttcacggacacaaagagctcgccacaaagatccgcctgtggcatcaacagggcgaacgatgtctttacaccgggaaaaacatatcgatccacgacctgattcataacccccaccagtatgagatcgatcacattttgcctctctctctgtccttcgacgatggattagcaaataaggtgctggttctagccactgctaaccaggaaaagggtcaacggacgccatttcaggccctcgactcaatggatgacgcatggagttacatcgagttcaaacagtatgtgcgtaatagcaagtccctgtctaacaaaaagaaagattaccttttgacagaggaagacataagcaagattgaggtcaagcagaaatttatcgaaagaaatctggtggacaccaggtactcaagtcgcgtagttctcaacactctgcaagagttctataagaccaatgattttgacacaaaaatttccgtggtccggggccagttcaccagccagttaagaaggaagtggaaaatcgagaagtctcgagatacttaccatcaccatgcggtggacgctctgataatcgccgcatcaagtcagcttcgcttgtggaagaaacaaaacaatcccctcattagctatcgggaagggcagctggtcgatcctgagacaggagaaatcctatccctgacggacgatgagtacaaggaactcgtgctgagaccaccctatgactacttcgttgatacccttaaatctaagtcgtttgaggacagcattttgttctcctatcaggtggattcaaaatacaacaggaagatcagtgacgccactatatacggcacacgtaaggctcagctgggtaaagataagcaagaggaaacctatgtattagggaaaattaaggacatctactctcagaaaggctatgaggactttatcaagcgctacaaaaaggatacaactcagttcctcatgtatcacaaggacccgcaaacctttgccaaagtcattgaagagatcctgaagacgtaccctgataaagaacttaatgagaagggaaaagagattccctgcaacccattcgaaaagtatcggcaggagaatggccctataagaaagtacagcaaaaaggggaaaggacccgaaatcaagtccctgaaatactatgacaacaagttgggtaatcatattgatatcaccccagtgaactcacagaaccaggttgtgctccaaagcctgaagccctggaggacagacgtctactttaatcctcagacttctaaatatgagctaatgggcctgaagtactccgatctccgattcgaaaaagggagtggaagctatggcatttctccagagaagtacaacaaagtgaaggcaaaggagggtgtagacgaagattccgagtttaaattcaccctgtataagaatgaccttatcttgataaaagatacagaaactggggagcagcagctgtttcggtacggctcacgcaacgacaccagtaagcactacgtggagttaaaaccgtatgaaaaggctaagttcgagggaaatcaacagctcatgaacctgcttggcacggttgccaaagggggacagtgtctgaagggcatcaataaacccaacctaagcatttacaaggtcaaaacagacgtgctcggtaataagtattttatcaaaaaggaaggggatcagcctcaactgaacttcaagaaaaagatttga

SEQ ID NO: 2801 - RNA, 3378 nt, synthetic construct
  misc_feature 1..3378: note = Cas9 variant
  source 1..3378: mol_type = other RNA
atgaccagcaagcaggagaacctgggcgccctcacattcgggcttgacatcggaattgcttccgtgggttgggcagtcctgggcgaaaatagaataatcgatttgggggttaggtgctttgacaaagccgagactgcgaaggaaggagagtctttaaacctggctcggcgcatggcccgactactccgtagaaggctgcggcgcagagcatggaggcttacgaaactggcccggttgctcaagcgcgaaggcctgattgctgatgcaaatctgttcaaaaacaagatcgagaagaatacccccgtgcctaaatcaagttggcagctccgagtagacgccttagatagaaagctgaacgctgaggaatgggccagggtgatttaccacctttgtaaacatcggggttttcactggatcagccgtgcggaggaaaaggcagccgagtccgactctaaaggggagtcgggaaaggtcaagcagggcttggctggcactaaaaagctgatgcaggagaaaaattatcgcacagccgcagaaatggtgctagctgagttcccagaagcccagagaaacaagcaaggggattactcaaaagcgctcagcaggatactgcttggagacgaactgaagaccttgtttgagcatcagcggaaactcgatagtccgttcgccacagagaagctggaagcagctatcttaggtaatggcgaccgaaagtccgggctgttttgggcccagaaccccgctctcgccggatctgatcttctgaaaatgttgggctattgcaccttcgagaagactgaataccgcgcacctaaagccagctttacagctgagagacacgtttggctaaccaggctgaataacctccggattgtggtcgacggtacgactcgcccactgaatgaagcggagagaaggatcgcacttctgatgccctatcagcaagccggggatttcacctacaagcagttgcgtacagctctcactaaagccggatttctgcctgagtccttccggtataccggcttatcatacgcaagtggccagaaggccggggaaaagacaaaagacccagagagcgctgccctggtgaagtttcccgcatggcaggaactacgaaaaaccctcgagaagaaagaactggcgtctgagtggcaaaagatttccacggacgctcttgatggaaagcctcagttgctggaccagatcgcctgggtactctcagtttacaaagatgacgatgaggtgaaggcagaactgagcaaacttaacctgccaaatgccgagaagatgatagacgctttgctcgatattagattcgacaaattcagtaacctgtctttaaaggccctgtgtaagatcgtcccgctaatggaacaaggtcagaggtatgatgaggcaattgctaacatccccgagtacggccatcactcccagctccacaaagtgggggccggagaacataagtatctgcctccattttacaaagagcgcgacaagactggccggatggtgttcaatgatgacatggacatccccagaaaccctgtcgttcttagggcgttgaatcaggcccgcaaagtggtaaacgctctgattaagaaatatgatagcccacacgaagtgcatatagagatggcacgagacctctcgcggcccctggatgaacgtagagaggtcgagaagttacaaaaggaatttagggacaataacgagaaaggtaaggcccagttcgctcaggattttaatatcgtgggggccgttaaaggcaaggagttcgaaaaataccagctgtatcgcgaacaacagggaaagtgcgcatactctattgagccgatggacatccaccggctttttgagcagggctacgtggaaatagatcacgcgttgccttattccagatcattcgacgatagtaagaacaatagggtcctcgtgctggccaaagagaaccgagacaaggggaatcgcacaccctttgaatacctaggaggtaaagataacagcgagccatggcggcagttcgtagcttttgttgaaggcaataaggcctatagactggcaaaaaggtcccgtctcctgcgcaaggacttcggggataaggaggctaaagagtttcgggaaagaaaccttaatgacaccaggtacatttgtaagttcttcaaaaactatgtggagcaatacttgcagctgcatgaagactctgaggccaagcgatgcgtcgtgttaagcggacagatgacttcatttctccgggcacgctggggcctggtcaaagtgagaggtgatagtgacaggcaccatgcccttgatgctgcggttgtggccgcatgttcccacgggatggtaaagcggctgagcgactattctcgaagaaaggagttggaacaggtccgcgagggcttcgtggatgttgacacaggagaaatcgtgaaccctgctatgtttcaacaggtccaggagcatttccccaatccatggccccactttagggatgaagtgaaactccgtctgtcaatggacgatcctgccctactgcggagtgagatggagaagttcggcacctacacgccagaagccctccaagctctgcacccgctttttgtaagcagagcaccccagaggcgcaactccggggccgcgcataaagacaccatctacgctcagcctaagcgattggtggcccagggaggtgttacacaaaaagtcgcactgacttctttaaccctcaaggatctggacaaacttattgatccacacagaaatgacaagctgtatacagccatccgggctaggctagagcagcatggcgggaagggagacaaagcattcccctcgagcaaccctctccgcaagccagattccgaaggcaatcccactggtccgattgtgcgtggggtgaccatggtcatagacaaactgtcaggcatccctattagaggaggcatcgccaagaacgatagtatggttcgggtggacgtgtttacaaaagcgaataagttccacttggtaccagtctacgtgcaccataccgttgctaaggccctgcccaacagggcagtggtcgcctttaaagatgaggacgaatggactttaatcgatgactctttcgatttttgcttcagcctccaccctaatgacctggtgcaggttcagcaaaaggggaaagctggaatgattggctattactcctcatgtcatcgcggtacggggaacataaatctttgggcccacgatcgaaacctgcaagtgggaaaggacggcatgatcgagggtattggcgtaaaaacagcattgagcctcgagaagttcaatgtcgacgtgctggggaacagatatcccgctccacctgaaaagcggagggatctagcctga

SEQ ID NO: 2802 - RNA, 3378 nt, synthetic construct
  misc_feature 1..3378: note = Cas9 variant
  source 1..3378: mol_type = other RNA
atgaccgacagaatcagcctgggcctcgatattggggtggcctccgtcggattctctgttcttgacatagataagggtaaagtgatcgagctgggcgctaggttgtttaacgcaacagtagccgcggggaatcaggaccggcgcgatatgcgaggatcacgtagattactgaacaggaataagcaacggcgcaaagacgtgagtaagctattccaggaatacggcctcctggataactttgacagagataatttccacactgcttttaacaataactggaatccctatgagcttagggtcaaaggtctgacgaagcagttgaacaaggaagaactcgccgacagcctgtaccagattatcaaacggcgcgggatttcctatgcactgaaggatgccgacgctaatgaagatggaaccgactactcttcgtcactcaaaatcaacagccaagagttaatagagaagactcctgcacagatccagctgcagcgacttaatgactatggcaaagtgagaggcaaggttattgtgggggatgacatcgatgaccaaaaggtcttgctgaacgtgttcccaacaaatgcctacgaaaaagaggctaggcagattatcgccacccagcagcaattttatccggaaatactaacaggagagttcgtaaaggagtactgccagattctcacccggaaacgtgattactttgttggtcccggcaacgaaaagagtcgcactgactatgggatctacaaaacagatggaagaaccctggacaaccttttcgaggaactgattggccatgataagatctatcctgacgagttgagggcgtccgcagcctcttacacggctcagctctttaatgtgctgaacgatttaaataacctgcggatcctcagctatgaagacggtaaacttactcaaattgacaaggagaagataatcgccgagattaaaaataacaccacagtcgtgaatatgctgaacgtgatcaagaaagtcactgggtgtcagaaggatgacataaaaggattccgattgaatgaaaaggataagccagagatttcctcaatgcccatctaccgcaaagcacacaaggactttctaaaagttggcatcgatattaccgactggcctatcgatttcattgacagactgagtttcatactcacactgaacaccgaaaatggcgagatcaggaagcagattaacaaacggcttgtgccagattttgacttcctgaatgatgacttggtacagctcatcatcgataacaaggacagctttgacattaagacgaataacaaatggcatcgcttctctctgaagactatgaacaaattaatacccacaatgatcgaaagacctgtggagcaaatgaccctgctaactgagatggggctcattaagaaagatacaaagaggtttgaaggaaataagtatctgccatacaaagagatcgctaacgacattttcaatccggtcgcctccaagtcagtgcgtgaagcgcttaaaatcgttaacgccgtgttgaagaaatacggtcacatagagtatatcgtcattgaaatgccccgggataagaatctggacgaggagcgaaaacagatcgcagattttcagaagaagaacaaaaagattaaagacgctgccttcaatgcttttgtgaaggccgtaggcagcaaaaagaacgttaagatcgcactcagtaaaaatagaaagctgcagatggggataaggctttggcatcaacagcagggaattgatccttacaacggcgaagagatcaatgccaacgacctgatttctaatccagataaattcgaaatcgaccacataatcccccagtccattagctttgatgacggtatcaacaataagaccttgtgcttcgcttcgatgaaccaagtgaaagggcagaagacgccttatgagtttctcaacgagggccacggacagggctacgcgaagttcaaagcaattgtctctaagaataaaaacttctccaaggccaaacgcgataattatctgtttgaagagaacgtgtcaaatatcgaaacccggaagagattcttaagtaggaacctggtcgacacacgctacagctcccgagtggttctaaattctctccaggagtttttccatgaaaagagcgacgatactaaagtgaccgtaatacgggggaagtttacatcaaacatgcgtaaacactggcatattgacaagactagagataccttccaccaccatgctatcgacgccagtatcattgcagccacaccatttctgaggatgtggaaaaagggatccaccatcttccccactaaaattaatgagacgagcatagatatcgagacaggtgaaattcttgacgataagaactttgacaaggtcatgtatgaggaaccgtactctggcttcatctcagagattatgaatgctgatgaccgcatcaaatttagtcaccaagtggataagaaaatgaaccggaaggttagcgacgccaccatatactccactagaatcgggaaattgtctaaggacaagaaagatgcagaatatgtggtcgcgaaggtgaaagacatttactcggtagatggatatgagaatttcaagaaagtgtacaagaaggacaaaaccaagtttctgctctataaatacgatcctaggacattcagcgagctggaaaagatcgttattgactatcccgataaaatcgagaaggtccagaccaacggcaagataaaagctgtggacatttccccattcgaattataccgacgcgataatggtatggtgcggaagtacagtaaaaagactgggcctgccatcaaacagctgaagtatcttgacaagaaattgggctcacatatcgatattacacccaagaacgcaaacaataaacacgtcgttctccaatctctgaagccatggagaacggacgtgtacctaaaccatgagaccggagaatatgagataatgggcatcaaatacagcgatctgaagtttaataaaaacgaggggtatggaattaagaaggacaaatacctcaagatcaaaaatattgaaggtgtgtccgagaactcagagttcatgtttagcctgtataggaaggaccgtatcaaagtacaggatatggagactaatgagtctgtcgaacttttgttctggtcccgcaactttagtaataagaagtacgccgagctgaaacccataagccagatcgacaacgataaggtgttacctatttacggccgggggagactcatcaaaaggctgattccaaagaattgtaaaatctggaaggttaacacatctatacttggagacacctattacctggaaaaggagtccaattatccgcagaaaattttggattga

SEQ ID NO: 2803 - RNA, 3381 nt, synthetic construct
  misc_feature 1..3381: note = Cas9 variant
  source 1..3381: mol_type = other RNA
atgaacggcctggtgctcgggcttgacatcggaattgccagcgtcggtgttggcatactgaataaggagaccggggaaatcattcacgctaactccagaatcttccccgcagccacagcggattctaatgtggagaggcggggatttcgccagggccgacgtttgggtagaaggaaaaagcatcggtcagctcgcttaaacaatctgttcgaagagtttgggttcattactgactttagtgccatccctctaaacctcaatccatacgcactgagagtaaaaggacttagcgaagagctgacgaacgaggaattgttcatagccctcaagaatatcattaaaaggcggggcatctcctatctggatgacgcttctgaggatggcgaaaccgcatcgaacgagtacgggaaggccgtggaggaaaatcgcaagctgctcgctgacaaaacaccgggacaaattcagttagagcgatttgaaaagtatggtcaggtcagaggcgatttcactgtggttgagaacggggaaaatcacaggctgatcaacgtgttttcaaccagcgcctacaaaaaggaggcggagcggatacttcgtcgccagcaagaattcaatgtcagaattagtgacgagtttatcgaagcatatttgacaattctgaccggaaaaaggaagtactatcatggccccggtaacgagaagtcccggactgattacgggcgattccgcacagacggaaccacgctagataacatctttggcatcctcattggcaaatgcactttctaccctgacgaatatagagccgctaaggcctcttacaccgcacaggagttcaatctgcttaacgatctgaataacttgacagtgccaactgagaccaaaaagctcagccccgaacagaaaaggcagatagtagagtatgctcggacagccaagaccctggggacgcctactttactgaaatacatcgcgaagctcgttgacggatccattgacgatatcaagggttatcgcatagacaaatcagataagccagaaatgatgcacacatttgacgcctacagaaaaatgaggacccttgatctggtgaatattgacgcattgagtcgtgagactctagatgacctggctcatatcctcacactgaacaccgaaagcgagggcatccttgaggccctgaattctaagatgccctccacgttcaccaaagaacaaattgatgagttgatccagtttcggaagaagaactcagctgtcttcgggaaaggatggcacaattttagcctcaagctgatgaacgaattaattagtgagctgtatgagacatctgaagagcagatgactatactaacccgactcggcaaacagagatccagggaaatcagcaagcgcacaaaatacattgacgagaaggaactgactgaggagatctacaatcctgtggtggccaagtcggtccggcaagcaatcaaaattataaacgaagccaccaagagatatggtatcttcgataatattgttatcgagatggctagggaaaacaatgaggaagacgcgaaaaaggactacattaaacgccagaaggcaaaccaggatgagaagaacgcctctatggagaaagctgcctttcaatataatgggaagaaagaacttccagactccatcttccacggccataaggagttggcaacaaaaatacgactgtggcaccagcagggagaacggtgtctctacaccggcaagaacatctcaattcgtgatctgatccataatccgcaccagtatgagattgaccacatccttcccctgagtttgagctttgatgacgggctcgccaacaaagtgctggtattagctactgccaatcaagaaaagggacagagaacgcctttccaggcaatagattccatggacgatgcgtggtcttacagggagtttaagcagtatgtgcgcaacagcaaatcactgagtaataagaaaaaggactacctactcacagaggaagatatttccaaaatcgaggtcaagcaaaagttcattgaacggaacctggtggacaccagatacagctctagggttgtgcttaatactttgcaggagttttataaaaccaacgatttcgacacaaagatctcagtcgtgcgaggtcagttcaccagtcagctgcgccggaaatggaagatagagaaaagcagagacacttaccatcaccatgctgtagatgccctcatcattgcagcctcctctcaactgaggttatggaagaagcagaataacccactgatctcgtataaagaaggccagtttgttgaccccgagacaggggaaattcttagcttgacggatgacgagtacaaggaactcgtgttccgtcctccatatgattactttgtcgacaccctgaaatccaagtcattcgaggatagtatcctattttcttatcaggtggacagcaaatacaatcgcaagatatccgatgctactatttacggaacacggaaggcccaactgggcaaagacaagcaggaggaaacctatgtcctcggtaaaatcaaggatatctactcacagaaagggtatgaggacttcattaagagatacaacaaagatgaaacacaatttctgatctatcacaaggacccccagactttcgagaaggtgattgaagagatacttaaaacctacccggacaaggagttgaatgaaaaaggcaaggagatcccttgcaacccctttgaaaaatataggcaggagaacggaccaattcgaaagtacagcaagaaaggcaaggggcctgaaatcaaaattctgaagtactatgataataaattaggaaaccatatcgacataacgcccgttaattctcagaaccaagtggtactccagtccctgaagccatggcggaccgatgtctacttcaatccccgcacaagtaagtatgagcttatgggtctgaaatacagcgacttgagatttgagaagggctctgggtcctatggaatctcacctgaaaaatacaacaaggtgaaagcaaaggagggcgttaatgaagatagtgagttcaagtttactctctataaaaacgacctgattctaatcaaggataccgagacaggtgaacagcagctgttcaggtacgggagccggaatgacacttcgaaacactacgtggagctcaagccatatgaaaaagctaagttcgagggcaaccaacagctgatgaatcttttgggaaccgtcgccaagggcgggcagtgtctgaaaggaattaacaagccgaatttatccatctacaaagtgaagacggatgtactcggcaacaaatattttataaagaaagaaggtgaccagccccaactgaatttcaagaagaaattttga

SEQ ID NO: 2804 - RNA, 3381 nt, synthetic construct
  misc_feature 1..3381: note = Cas9 variant
  source 1..3381: mol_type = other RNA
atggccagcaagcacgagaacctgggcgctctcaccttcgggcttgacatcggaattgcatccgtgggttgggccgtcctgggcgaaaatagaataatcgatttgggggttaggtgctttgacaaagcggagacagctaaggaaggagagtctttaaacctggcccggcgcactgcacgactactccgtagaaggctgcggcgcagagcctggaggcttacgaaactggctcggttgctcaagcgcgaaggcctgattgcagataccaatgtgttccagaaaccctttaacctgaaggacgccaatgagaagggtctctcattctggcagttacgagtagatgctctggacagaaaacttagtgccgaggaatgggcgagggtgatctaccatttgtgtaagcaccgggggtttcattggattagccgtgcagaggaaaaagccgctgagggagattccaagtctgagggcggcaaagtcaagcaggggctggccggaacaaagaaactaatgcaggaaaagaactatcgcactgcagctgagatggtgctcaccgagttccctgaagcccagagaaataaacaaggtgactactcgaaggcgctgtcaaggatccttctgggcgatgaaatgacacagttgtttaaacaccagcgggagctcgggaacccacatgccaccgagaagctggaagcagctatattaggaaatggcgaccacaaaagcggtctgttctgggcccagaacccggctctcgccgggaatgatcttctgaagatgttgggacactgcacttttgagaaggcagaatatcgagttcccaaagccagtttcacagctgagcgccatgtgtggctaaccagactgaacaatctcaggatcgtcgtggacggcacgactcggcctctgaacgaagcggagcgccaccttgcactgttgatgccataccaacaggccggcgatctcacctataagcagctgagaacagctttaactaaagccgggtacctgcccgagtcctttaggtataccggactagcatacgcctctggtcagaaggctgacgaaaaagccaaggaccctgagagcgcaccactcgtaaagctgcccgcgtggcatgaacttcgtaaaacattggagaagaaagaactggcttccgagtggcaaaagatttcaagtgatgccctcgacggcaaacctcagctgcttgatcagatcgcatgggttctgagcgtgtacaaggacgataccgaggtcgaagccgagttgtgtaagctcaatctgccaaacgctgagaaaatgattgacgccttactggatatccggttcgacaagttttctaacctatccctcaaagcactgcgacaaatagtgccgcttatggaacaggggcagagatatgatgaggctgtggccaatattcccgaatacggacaccactcacagttgcatgaggtcggcgcgggtgaacacaagtatctgcctccattctacaaagagagggacaagacggggcgcatggttttcaacgatgacatggacatcccccggaatcctgtggtactcagagccctgaaccaagctaggaaggtggtcaatgcattaattaaagaatatggcagcccacatgaggtgcacatcgagatggcccgcgatctgagtcgaccccttgacgaacggcgtgatgttgagaagttgcagaaagaatttagagacaggaacgagaaggataaagctctcttcgcccaggactttaatatcgtgggagcagtcaagggcaaagagttcgaaaagtaccagctgtatcgcgagcaacaggggaagtgcgcgtactctattgaaccgatggatatacatcggctatttgagcagggatacgtggaaatcgaccacgccctgccttattccaggagcttcgatgactcgaaaaacaatagagtactcgttctggctaaggagaaccgagataaaggtaatcgcactccctttgaataccttggcgggaaggacaactctgagcggtggagacagttcgtggcctttgtcgagggaaataaatcctataggttggcaaagcgttcacgcctgttacggaaggatttcggcaaagacgaagctaagggttttagagagaggaacctcaatgacacacgatacatttgtcggttctttaaaaactatgtggaacaatacctgcagcttcacgaggatagtgacgccaagcgctgcgtcgtgctgagcgggcagatgacctccttcttgagagcaaggtggggcctcgttaaagtgcggggagattctgaccgacatcacgccctggatggcgctatcgtagcggcctgtagccattcaatggtcaagagactaagtgactattcccgcaggaaggagctggaacaggtgcgtgcagggttcgttgatgtggacactggagagatagtcaacccagctatgtttcaacaggtgcaggaacacttccctaatccctggccacactttcgggatgaggtaaaactcagactgaacgtggacgatcccgcccttttgcatagcgaaatgaataggttcggtacatactctcctgaggccctgaaggctttacgcccactctttatttcacgagcaccgcaaagacggaacagtggcgccgcgcacaaagacaccatctacgctcagcccgagaggctggttgcccaagggggagtcacgcagaaggtgcctcttaccagcctgacactaaaagatctcgacaagctgatcgacccacatcgcaatgaaaagttgtattccgcaattcgtatcagactggagcagcacggcggtaaaggggataaggccttccccgcttctaaccctttacggaaaccagactcggaaggcaatcccactggaccgattgtgaggggcgtcaccatggttatagataagctcagcgggatccctattcgcggaggcatcgccaaaaacgactccatggtgcgagtggatgtatttacaaaggcaggtaaattccatctggtcccagtgtacgttcaccacgcggtggctaaggtccttcccaatagagccgtggttgcatataaggacgagactgaatggaccctgatcgatgacgggtttgatttctgcttttcaatgtaccctaacgacttgctccggattaaactgaggaatgccagtcatctaggatattacgcttcttgtaaccgcagcacaggcgccataaatctgtggtcccacgatagaaaccaacaggtgggtaaggacggcatgatcgagtcaattggggtaaaaaccgcacttaatgtcgagaagctcaacatcgacgtgctgggaaacaggtatcccgctccacctgaaaaacggcgtgatttggcctga

SEQ ID NO: 2805 - RNA, 3384 nt, synthetic construct
  misc_feature 1..3384: note = Cas9 variant
  source 1..3384: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatgtagagaggcggattaaccgccaaggacgacgtttgacaagaaggaagaaacatcggcgcgtgagattaaatcacctgtttgaagagtcaggcctaatcactgacttcacgaacgtcagtataaatctcaacccttaccagctgagggtgaagggtcttaccgatgaactgagcaatgaggagttgtttatcgccctcaaaaacatggttaagcatcgggggatttcctatctggacgatgcgtctgacgatggaaattcgtcagtgggcgactacgctcagatcgtcaaggaaaacagcaaacagctggagacaaagactccaggccaaattcagctcgaacgctatcagaaatacgggcagttacgaggagatttcaccgtggaggaggacggtaagaaacacagactgatcaatgtatttccgacaagtgcctatagggcagaagcccttcggatattgcaaacccagcaggagttcaacccccagattactgatgaatttatcaattcctacctgcaaattctaacaggcaagcgtaagtattaccatgggcctggaaacgagaaatctcgcaccgactacggcagatatacgactaagaaagatagcgaagacgagtacatcaccctcgacaacatcttcggtattctgatagggaagtgcacattttatccagaggaatacagggctgcaaaagcctcctatactgctcaggagttcaatcttctgaacgatttgaataacctcaccgttcccacagaaaccaagaaactgtcagaggaacagaagaatcaaatcattacgaacgtgaagaatgagaaagccatgggacctgcgaagttatttaaatacatcgcaaagctgctcagttgtgacgtcgccgatataaaaggctatcggattgacaagagcgataaggctgagatccacactttcgaagcctaccgaaaaatgaagacacttgcaaccatcgacattgagcagatggaacgcgagaacctggataaattggcttacgtgctaactctgaatacagaaaaggagggcatccaggaggccctcgaacacgagtttgcggacgggaccttctctcaggaacaaattgatgagctggtgcagttcagaaaagccaactcctcaatatttggaaagggttggcatagcttcagtgtcaagctgatgatggagcttatcccagaattgtatgcaacgtctgaggaacagatgaccattctcacaaggctgggcaaacagaagactacctccagctcgaataaaacaaagtacatcgacgagaaacaattaactgaagagatctataaccccgttgctgccaagtctgtgcggcaggctattaagatagtaaatgccgcaatcaaagagtacggggattttgacaacattgtgatcgaaatggcccgcgagaccaatgaagacgatgagaagaaagctattcagaagatccagaaagcgaacaaggacgaaaaagatgcagccatgctgaaggctgccaaccaatataatggaaaggcagagctacctcactccgtcttccatggccacaaacagctcgccacaaagataagactgtggcaccagcagggtgagaggtgcctttacaccgggaaaactatctcaattcatgacttgatcaacaatagtaaccaatttgaaattgatcacatcctgccactcagcataacgttcgacgattccctggctaataaggtgcttgtttatgccacagcaaaccaggagaaaggccagcgtaccccgtaccaagcgctggactctatggatgacgcttggagctttcgggaattgaaggccttcgtgcgagattcaaaggcactcagtaataaaaagaaagagtacctgttaactgaagaggacatttccaagtttgatgtcagaaagaagttcatcgagaggaacctggtggacacccgctatgccagccgggtagttctaaatgctctccaggaacattttagagtgcacaagacagacaccaaagtctctgtggtcaggggacagttcacttcacagctgcgccgacattggggcattgagaagacacgggatacgtaccaccaccatgccgtggacgcacttatcatagctgccagtagccaattgaacctgtggaaaaagcagaaaaataccctcgtttcctattctgaagatcagctgttagacatcgagactggggagctgatttcggatgacgaatacaaggagagcgtgtttaaggcgccctatcagcacttcgtagatacacttaaatccaaggagttcgaagactcaatcttgtttagttaccaagtcgattctaaattcaaccgtaagattagcgacgccaccatctatgctacaagacaggcaaaagtgggaaaggataaaaaggacgaaacttacgttctcggtaagataaaagatatttactcccagaccggctatgacgcctttatcaagatctacaaaaaggacaaatcaaagttcctgatgtataggcatgatcctcagacgtttgagaaggtgattgagccaatcctagaaaattaccccaacaaagagctgaatgaaaaggggaaagaggtcccttgtaacccattcctcaagtataaagaagaccacggatacattcgcaagtatagcaagaaaggcaacggtcccgagataaagtctctgaaatactacgattccaagttggggaatcacatcgacattaccccgaaaaacagtaataacaaggtggtacttcaaagcgtgtctccttggcgggctgatgtttattttaataagacaactggcaaatacgagatcctgggattaaagtatgccgacctcaaattcgaaaagggcaccgggacatacaaaatttccgaggaaaagtataacgatatcaagataaaagagggagtcgactcagatagtgaatttaagttcactctgtacaaaaatgaccttctgttgatcaaggataccgagacgaaagagcagcagctctttagattcctgagcaggacaatgcccaacgtgaagcattatgtggaactaaaaccatacgacaagcaaaagtttgacgataatgaggaactgattaaaatcctcggtattgtcgcaaagggcgggcagtgcaaaaagggagtttcgaaacctaacatctccatatacaagattcgaaccgacgtgctgggcaatcagcacatcatcaagaacgagggtgataaacccaaacttgacttctga

SEQ ID NO: 2806 - RNA, 3384 nt, synthetic construct
  misc_feature 1..3384: note = Cas9 variant
  source 1..3384: mol_type = other RNA
atgaacggcctggtgctcgggcttgacatcggaattgccagcgtcggtgttggcatactggagaaggattccgggaaaatcattcacgctaattctagaatcttccccgcagccaccgcggacaacaatgtggaaaggcggacatcacgccaggctcgacgtttgaacagaaggaagaaacatcggagtgtacgcttacacgatctgtttgaggaatacggactactcactgacttcagcaaggtgtccattaatctgaacccttatcaaatcagagtccagggccttgataaaaggctgacgaatgaggaattgtttatagccctcaagaacatcgtgaagcggcgcggtatttcttacctggacgatgcatcggaggacgggggagccgtttcaagcgattatggcaaagctgtggaggaaaatcgaaagctgctcgcacagcagaccccaggccaaatccagttagacagattcgagaaatacgggcaggtcaggggagattttacagtggtagaaaacggtgagaagcggcgtctgattaatgttttcagtacttccgcctatcgcaaagaggctgaaagaatccttaggaagcagcaagagtttaacaataagataaccgaaggcttcattgaggactacttgacaatcctgaccgggaaacggaagtattaccatggaccgggcaacgaaaaatctcgaactgattacggtcgctatacaaccaagaaagacagccagggggagtacattacgctagacaatatctttggaatcctcattggcaagtgcactttctatcccgatgagtacagagcctccaaagcgtcatataccgcacaggaatttaacctgcttaacgacctgaataacttgacagtgcctactgagaccaagaagctcagtgtcgaacagaaaaagacaatagtggagtacgccaaaaccgctaagacgctgggcgccagcactttactgaaatatatcgcaaagctcattggggtgtctgtcgatcaaatccacggatacaggatagacccaaatgaaaagcccgagatgcatacattcgaggtttaccggaaaatgcagtcccttgaaaccattcgcgtggaggaactgcctagaaaggtaatcgatgagttggctcacatcctaactctgaacacagaaagggagggtattgaggaagccatcaatgcgaaactcaaggacatattttcacaggatcaagtgctggagcttgtccagttccgtaaaaacaatagcagtctgttctctaagggctggcacaacttttccttgaagctcatgatggaactgattccagagttatatgagaccagcgaagaacagatgacgatcctgacccggctagggaaacagaagtcgaaagaaacatctaagcgaactaaatacattgacgagaaggaactcaccgaggagatctataatcccgtggttgccaagtccgtgagacaagcaatcaaaattataaacgaagctacaaagaggtacggaatcttcgataatattgtcatcgagatggcccgcgaaaacaatgaggaagacgctaaaaaggagtatattaaacggcagaaggccaacctggatgagaaaaatgcagccatggaaaaggctgcgtttcagtacaacggcaagaaagagcttcctgacaacgtgttccatggtcacaaggaattggcaactaaaatcagactgtggcatcagcaaggggagaagtgtctctataccggcaaaaatataccaatctcagacctgattcagaacaggtacaagtacgaaatcgatcacattcttccgctgagtttgagctttgacgattccctctctaataaggtactggttttagccacagctaaccaggagaaaggacagcgcacccccttccaagccctggacagcatggattatgcatggtcataccgagagtttaagagttatgtgaaagactccaagctactcagcaataaaaagaaggattacctgcttactgaagaggacatctctaaaatagaagtcaagcagaaattcattgagcggaacttggtggatacgcgttattcaagtagagtcgtgctgaatgccctccaggacttttacaaggagcaccagttcgatacaaccatcagcgttgtgaggggccaatttacttcccagctgcgccggaaatgggggattgaaaagtctagagagacctatcatcaccatgctgtagacgccttaatcatagcagcgtcgagccagctgaggctttggaagaaacacaacaatcctttgatctcctacaaggaggagcaattcgtcgattcagaaacaggagagattatcagtatgtctgacgacgagtacaaagaactcgtgtttaaggctccatatgatcatttcgttgacaccctgaaaagcaagaaattcgaggattccattctattttcataccaggtggacagcaagtataaccgaaagatctctgatgccactatatacgcaacacgcaaagccaagctggacaaagataagtccgaagagacgtatgtcctcggtaaaattaaggacatctacagtcaggctggctatgataccttcatcaagatttacaataaagacaagagccggtttctgatgtaccacaaagatccccagactttcgaaaaggtgatcgaggagattcttagaacatatccttctaaagaattgaacgagaagaataaggaagtaccatgcaacccctttgagaaatacaggcaagaaaatgggccgatacgtaagtattcccgcaaaggaaacggccctgagatcaagtcactgaaatactatgacaacaagttaggtaatcacattgatatcacccccaacgagagtatgaatcaggtggttctccagagcctgaagccatggcggacagacgtcttctttaaccatcagactgaaaaatacgagcttatggggctgaagtattcggacttgaatttcgaaaaaggctccggaaagtactctattagcctcgagaaatacaactcaatcaagatgaatgagggcgtgagtgaagagtccgaatttaagttcaccctgtataaaaacgatctaatactgatcaaggacgccctcacgaaagaggcacaaatttttagatacgggtctaggaatgataccagcaagcactatgtggaactgaaaccttacgacatgtccaagttcgagggagatgagcgacttatcaaagtcttgggtacagttgctaagggcgggcggtgtattaagggactgaacaaaaaggacatctcaatatttaaagtgaagactgatgtgttaggcaataaacatttcattaagaaggaaggtgaggaacccaaactcaagttctga

SEQ ID NO: 2807 - RNA, 3387 nt, synthetic construct
  misc_feature 1..3387: note = Cas9 variant
  source 1..3387: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctaaacggcgcgccggtcgaactacgcgtagaaggttgtcacggaaccgctggagattaagtttcctgagggactttttcgaaagccatatcacccctacagatccaaactttttcatgcggcagaagtattccgagatttctccgaaggacaaagcacgctacaagtatgaaaaacgactatttaatgatagaactgacgccgagttctaccaacagtattcgaccatgtaccacctcaggaatcggctgatgacagatccctcacgtgctgacgtgcgcgagatctattttgcaatacatcacatccttaagagcagagggcatttcctgacccctggagatgccaaagactttaacactaatgatgtagctttggacgaaattttcccagccctccaggatgcgtacgcacaggtgtaccccgacctgggcatcacatttgacgaggataaggccaacgagttcaagaccattctgctcaatgagatcgctacgagtatagacactcaaagggccttagtcaaactgcttttggcagaggaagatgacaaggatattctgaaacagcagaaacaggtgctaaccgagttcgctaaagccgttgtgggcctcaagacaaaactgaaccttgcgctggggactgaagtcgactcctctgaggccaccgcatggaattttagcttgggacaactcgatgacaagtgggctggtatcgaatccgccatgacagatgagggcaccgagattctggaccagatccgggatttatatcgagctcgcctgctcaacgggatcgtgcctacgggaaagactctttcacaggccaaagtagacgactacacacagcaccacgaagatctgcaattgttcaaggcatatctaaaacagctggaggacgatggcaccgccaaggctattagacagctctacgacaggtatatagatggtgacgatgcggcaccatttctgcgggaaaatttcgttaaagcccttactaaggacgtgacagctcatcccaacaccaagagtcctgagctgttggaacgcctcgcccaaccagattttatgctgaaacagagaaataaggcaaacggggccatcccggtccagatgcagcaaagggagttagaccagattatcaaaaaccaggctgtgtactatgattggctggccgcacccaatcctgtggagaagcaccgtaaaagcatgccataccagctagacgaactcctgaacttccggataccctactatgtcggacctcttgttacggcgaaggagcaaaaggctgcccagggcggcgtgtttgcatggatggtacgaaaagatccagaagggaatattaccccctacaacttcgacgagaaggtggacagagaagcctctgctaatacatttatccagaggatgaaaactaccgatacatatttgatcggagaggacgtcctgccgaagcagtccctcctgtaccaacgctatgaggtgcttaacgaactgaataacgttcgggtgaataacgagaaattgtcaattgaacagaagcagcaggtcatcagagagcttttcgagaggcataatagcgtgactattaagcaatttgccgaaaacctgcgcgcacacggtgattacgctcacatacctgagatccgaggcttagccgacgaaaaacggttcctgagttctctatccacctatcgtcagctcaagagcctgcttcccgaggcgattgatgacccagccaaacaggctgatatcgaaaatatcattgcatggtcgacagtatttgaggacgccgctatattcaagaccaaattgaaggagatctcttggctggggtccgaagccattactaaactctcaaacatcagatacaggggatggggccaattcagtcgcaagtttctgaatggtttaacgctggggaacggccatacaattatccaggagcttttgctcagcaccaacaatctgatgcagatactaactgatgaaaccctgcagaagaaaatgacagagctcaacgcagacaagctgaaaaccgcgaatatcaacgatgccattgacaatgcttacacttccccttctaacaagaaagcccttcggcaagttttgagagtggtcgatgacatcaagagggcagctgacggacaggatcccagctggctgtatgtggaaacagccgacggcgggggaacgccaggtaagcgaacccgcgcacggcagcaccagttacaagagatttacgccaatgctgcgcatgagctcatcgatactgccgtcagaggcgaactggaggacaaaatatcagataaggcagacttcaacgataggcttgtgctgtattttatgcaagggggacgtgacatttacacaggcgctcccttgaatatcgatcagctcagttcctatgacattgatcacatcctgcctcagagcctaataaaagacaactctctggacaatcgcgttctcgtgcatgccatcattaaccgggaaaagaatgccaccttcgcttcaacaatctacgcacagaaaatgaacgccacttggagacagtggcacgaggcgggtctgattagtgggaggaagctccgaaatttgcagatgcggccagatcaaatcgacaagtatgctagcggctttgtagcccgccagctggtcgaaaccagacagataattaaattaacggagcagatcgtggcagcccaatacccggataccaagatcattgctgttaaagcaggactctcccaccagctgagggaggaacttgagttccccaagaaccgggacgtgaaccattaccaccatgcctttgatgcgttcctggctgcccgaatcggcacatatctactcaaaagatttcctaatctgcaggcattctttacttacgggaagttcaccaaggccgacgtcaaaaagttgcgcggatttaacttcattagggatataacacacgctgaagacaaaatcgtggccaaggatactggtgaggtagtgtgggacaaacagcgtgatgttgacgagctggatcggatttataatttcaagagaatgttaatcacccacgaagtcaggtttgagacggcagacctcttcaaacaaacagtgtacggcgctcgcgactctaaggaagccgggggatcgaagcagctgattccaaagaagaaagatatccagcttatatttatgggcgcgatcagcgagcgaaccagacccattctgcctttgtga

SEQ ID NO: 2808 - RNA, 3387 nt, synthetic construct
  misc_feature 1..3387: note = Cas9 variant
  source 1..3387: mol_type = other RNA
atggacgagaagatggattacagaatcggcctggacattgggatagccagcgtgggatgggctgtcctccagaacaattccgatgacgaacccgttaggatcgtggatcttggtgtacggattttcgacaccgcagagatccctaaaacaggcgaatctctggccgggccacgccgagcggctcgtactacgagaaggcggttgcgcagaaggaagcaccggttagatcgcattaaatggctgtttgagaaccaaggactaatcaatatagacgatttcctcaagcgatataacatggccggcctgccggacgtgtaccagcttagatatgaagcactggataggaaattgaccgacgaggagctcgcccaggtcctgctgcatatcgctaagcaccggggttttcgttcaacacgcaaggcagaaactgccgctaaagagaatggggccgtgctcaaggcgaccgatgaaaaccagaaaagaatgcaagagaagggatacaggacagttggcgagatgatttatttagacgaagcattccggatcggctgcagttggagcgagaaagggtacattctgactccccgaaataaggccgaaaactatcagcataccatgcttcgcgctatgttggtggaggaagtcaaggagatcttttcctctcagagaaggctgggaaataaaaaggccacagaggaactagaggaaaaatacctcgagataatgacctcgcagcggtcattcgacctgggtcctggcatgcaaccagatgggaagcccagcccttacgcaatggaaggatttagtgaccgcgtgggcaaatgtacgttccttggtgatcagggggagctgagaggagctaagggcacttataccgccgagtactttgtagcgttgcagaaaattaaccacacaaagctcgttaatcaggacggcgaaactaggaacttcaccgaggaggaacgtcgggccctgacattactgctctttacccaaaaggaagtgaaatatgcagctgtccgaaagaaacttgggctgccagaggatatcttgttctacaatctaaactataagaaagccgctacgaaggaggaacagcagaaggagaatcaaaacactgaaaaagccaagtttattggaatgccctactatcatgactacaaaaagtgcctggaggagagagtgaaatacctcacagaaaacgaggtgagggatctgttcgacgaaatcggtatgatccttacctgttataagaatgatgactcccgcactgagcggctggcaaagttgggcctcgtccctattgaaatggaggggctgttagcctacacaccaaccaaattccagcacctgtctatgaaggctatgagaaacataatcccgtttctagagaaaggaatgacgtatgataaggcgtgcgaagaggcaggctacgacttcaaagccgacagcaagggtaccaagcagaaactcctgacaggggaaaatgttaaccagactattaatgagatcaccaaccccgtggtaaagaggtccgtgtcacaaacagtcaaagtgataaatgctattatccgcacttatggcagtcctcaggccatcaacattgaacttgcacgagagatgagcaagacctttgaggaacggcgtaaaatcaagggagatatggagaaaagacagaagaataacgaagacgttaagaaacagattcaagagttgggcaagctgtctccaacagggcaggatatactcaaatacaggctgtggcaggaacagcaaggaatctgtatgtattccggtaagaccattccccttgaggagctgttcaaacctggctacgacatcgatcacatcttgccatactcaattacttttgacgatagcttccgcaataaggtgctcgtcacgagtcaggaaaaccggcagaaggggaatagaacaccctatgagtacatgggaaacgacgaacagaggtggaatgagtttgagacccgagtgaaaactaccatacgcgattataagaaacaacagaagctgctgaaaaagcatttctctgaagaggaacggtccgagtttaaggaaagaaacttaacagacaccaaatacatcactacagtaatttataacatgatcaggcagaatctagagatggccccgctcaaccgtcctgagaagaaaaagcaagttcgcgctgtgaatggcgccattacggcatacctgcggaaaagatggggtcttccccagaagaacagggaaaccgatactcaccatgcgatggacgctgtcgtgatcgcctgctgtacagatgggatgatacagaagatcagccgatataccaaagtccgggagcgctgctactcgaagggcacagaatttgtggacgcagagactggagaaatttttagaccagaggactactctagggccgagtgggatgaaatcttcggcgttcacattcctaaaccctgggagacctttcgggctgaattggacgtgcgaatgggggatgacccaaagggattcctggatacgcactccgacgtagccctcgagctggattatcccgaatacatctatgagaatttaagacctatattcgtctcacgcatgccaaaccataaagtgaccggtgcagctcacgccgacacaattaggagtccgcgtcattttaaggatgagggcatcgttctgactaaaaccgcgcttacagacttgaagctcgataaggacggggaaattgatggatactataatccccagagcgacctgctactgtacgaggccctcaaaaagcaactgcttttgtatggcaacgacgctaaaaaggcattcgcccaggattttcacaaacctaaggctgacggtactgaagggccagtggtccggaaggtgaaaatccagaagaaacagaccatgggcgtattcgtggattccggaaatggcatagccgagaacgggggaatggttagaatcgacgtctttagggtgaatggcaagtactacttcgtgcccgtctatacggcagatgttgtgaaaaaggtgctgcctaaccgcgcgtctacagccaataagccatacagcgagtggcgaaccatggaagacaaagatttcttattctcactctatagtagagacctggtacatattaagtccaaaaagggtatccccattaaaaacgtcgatgggagccttggagagtctaaggaagtgtacgcttattacatcggcgccgacatatcaggtgcaaagattgagggcaaagctcacgatagtcggtatacttttagggggatcggagttcaaaagctggaattgatcgagaaatgtcaggtggacattctcggccacatcagcacagtcaagaatgagaaacgcatggggttctcctga

SEQ ID NO: 2809 - RNA, 3387 nt, synthetic construct
  misc_feature 1..3387: note = Cas9 variant
  source 1..3387: mol_type = other RNA
atgaacgacaagaatcagaaatacagactgggcctcgatcttgggaccaacagcatcggatggtgcatttattccctggacgtgaataacaagcccgagacattgatagatatgggtgtcaggatcttctctgacggccgggatcctaaaactaaggaaccattagccgttgagcgccgaacggctcgtgggctgagaaggattctacaccggcgcaaactcagaaggcggcaaatgtttcgcctgcttcaggaacagggactgatgccgaatgacgcatcagaggccgcggctttgaagagtctcaacccctacgaactgcgagtgaaggccctggataccaaactcgagccttatgagttaggcagagcactgttcaatcttagcgtaaggcggggttttaagtccaaccgtaaagaagccgtgcaggagaaggaaaaagactctcaaaatgatgctaagtcgcagaacgagaagtgtgagcatttggcaaaagccatcaaggactcagggtgccgcacactgggagagttcctatggaaacacaagaatactgagacccagcagacagaaaacgatgctagaaatattggcatgaggtttgtcccaggccggagcaactactatcccacccgacgcatgtacgtggaggagttcgacgccatcagaaaagcgcaagaaccttattacagtggggttaattgggatgcactccatgagaagctgttttaccagaggccacttcgggcccaggaacgcggaaaatgtagatatatgcccgacaaggagaggactttcaaggctatgccttgctcccagaaaatacgtatcctgcaagaagtgtacaacatggactatattgatgagtacggtaagacaatcccattggaagaggcccagaccgactctctcattagcctgttagataaacgggagaagctgtcctttaaagcaatgaagaaggaactcggcatcgacgagtcatgtacgttcaaccttgaacgagggggaagagagtatctgcagggcaatgctgccgcggtcaaattgaggaacaagaaacgctttggtgaactatgggatagtctgagcctcgccaagcaagacgcaatagtggagaaactgattactgctgatgaggacgccgaaatcatttctatgcttgctcagtacaatctgaccgatgagcagaagaagaacatcgccgtaacagttttgccgtccgggactgcaatgctctgcaaagaagtgaccgagatgctggtccagaagatggagcaaaataaaatccccttaacagtggccgtgcagatgctgggatatacctacgctgaccagtcagtccgggaagaggatacgctaccttactatggcgcgattctcactggcagcacaatgggggcacacccagaagccgacgagagtgaacccgagctgaagtacggaaaaatatctaaccctaccgttcatgtggctcttaatcagactagaacagtagtgaacgccttgatcaaggcatatggtaagccacaacagattgtcgtggagctgtccagggacctcaaagccagccgcgaagctaaggcccgaatccagaaaaccataacgatgaatcagaagcggaacgagcgtgataataaaaacattaccgacatcacaaagatcccctacccgaatagaaacgataggctgaaatatcgcctttgggaagaactgggctcggggtctaattccttctcacggaagtgtttgtactgcggaaagcctattagtggcagcgaaatctttactgagaacattgagatagaacacatcctccccttcggtagaaccctgttcgacggggagacaaacaaaactgttgcacacaccgattgtaatagggacaagggcgatcgatccccatttgaagcgttcggatctagccctaacggctataattggcatgagatttgcgctcgcgccaactcactgaaaaatcccgcaaagcggacattatttgccgaaaacgctatggagaaattcgagaaggacaatagttttatccaaagacagctaaccgataacgcctacctctccaggagcgcactgcgttaccttcgctgtatctgcaaggacgtgtggtctattaatgggggaatgactaaattgctgcgggataagtggaacatagactcaatcctcaaaagaaagattgatgacccagaaatcgctcacttcgagctgaaaaatgaccagattggtcagtataagaagaacaggtacgatcatcgacaccacgccttagacgcgagtgtcatcgccctgatagatcgggctatggtgcaagaaatcagccagcttaataaaattcgcttgaagaacagaatcgaggcaccccagatgcctgtactcaggtccgagctgattgaaaaagttaagcatatcacggtgtcttttaaaccagaccacggccggcaagggaagctatcgaaggagacactgctcggaaaaataaagaaaattgaaaaggtcgatatcgacagcattcagaccgatgacatcgcctccataaaagatgacgctatccgaactagattcgagaccaagcgcagggaactgggcgatattacaaaagccaaggcagcgcttaagaccgagtttccgaaattggacgtgttcaagacttattacgtctcacgtacacccatcgtgagtctgacggagaaaaatattaactctatcgttgatgaaaagataaaagagaagttaaagacctttattaaagaacatgccgacctcagcttcgctgagcagctgcagaagttttccgaaactgagtggatcggtaaaccttcagccgcagggaagccaggcaaaaagtatcggatcgagaaggtgagatgcattaactggggacaaacacccatcaccattacaagctctgctgtacctaggtacctttgtccagaagactatctggccgcagtcgtgtggcagataccctccaaaaagaaagatactgagccggaatacaaggccaccttcttgcgccgagacgagttcgatgttaataacaaacctaagaagctcgaaaaaccacacgacgctgcgcagtacatctgcatgctgtataaggatgactacctagagtttacggagagtggcgccacccatctgtgtagaattgcagggctccccgctagccagaataacaaaatcgatattcggcctatctatgccgtgtctgactgcaaggattggataatcgccacaaatgaaaacatgctggagccctgttggaaaccacaaaaggaagagaagaggatttccgtcaatgtgcttttcggaaaacacaaggctcgctcagtaactgtgaaccctatcggtcgtgtttttagaaaatga

SEQ ID NO: 2810 - RNA, 3387 nt, synthetic construct
  misc_feature 1..3387: note = Cas9 variant
  source 1..3387: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatgtagagaggcggacaaaccgccaaggacgacgtttgactagaaggaagaaacatcggcgcgtgagattaaatcacctgtttgaagagtcaggcctaattacggacttcaccaaggtcagtatcaacctcaatccttaccagctgagggtgaaaggtcttatagatgaactgagcaacgaggagttgtttatcgccctcaagaatatggttaagcatcgggggatttcctatctggacgatgcgtctgacgatggaaactcgtcagtgggcgactacgctcagatcgtcaaagaaaatagcaagcagctggagacaaaaactccaggccaaattcagctcgaacgctatcagaagtacgggcagttacgaggagatttcaccgtggaggaggacggtaaaaagcacagactgatcaacgtatttccgacaagtgcctataggtccgaagcacttcggatattgcaaacccagaaggagttcaatccccagattactgatgaatttatcaaccgttacctggagattctaacaggcaaacgcaagtattaccatgggcctggaaatgaaaaatctagaaccgactacggcaggtatacgactaagaaagatagcgagaacgagtacatcaccctcgacaacatcttcggtattctgatagggaagtgcacattttatccagaagagtaccgggccgctaaagcatcctatactgcccaggagttcaatcttctgaacgacttgaataacctcaccgttcccacagaaaccaagaagctgtcagaggaacaaaagaatcagatcattaactacgtgaagaatgagaaagctatgggacctgccaagttatttaaatatatcgcgaagctgctcagttgtgatgtcgcagacataaagggctaccgaattgataaaagcgacaaggccgaaatccacacgttcgaggcttaccgcaaaatgaagactcttgaaacaatcgattttgagaaaatgtctagagaccagctggataagttggcctatgtgctaaccctgaacactgaaagggagggcattcaagaggcactcgaccacgagttcgctgatgggaatttctcccaggaacagatcgacgaactggtgcagtttcggaaggccaactcaagcattttcggaaaaggttggcataattttagtgtcaaacttatgatggagctgataccagagttgtacgcgacatctgaggaacaaatgaccatcctcacgcgcctgggcaaacagaagaccacatccagctcgaacaaaactaagtatattgatgaaaagttactgaccgaggaaatctacaatcccgttgtggccaaatctgtaagacaggcaatcaagattgtgaacgctgccataaaagagtatggggacttcgacaatatcgtcattgagatggctagggaaacaaacgaggatgacgaaaagaaagccatccagaagattcaaaaagcaaacaaggatgagaaggacgccgctatgctaaaagcggcaaatcagtacaacggacgtgccgaactccctcactccgtgtttcatggccacaagcagctggctactaaaatccggctttggcaccagcaaggtgagcgatgcttgtataccgggaagacaatatcaatccatgatctgattaataacccaaatcagttcgagatcgaccacattctcccgctgagtatcacctttgatgacagccttgccaacaaagttctggtgtacgcaactgccaatcaggaaaagggccagagaacgccctaccaggctttggattccatggacgatgcctggtctttcagggagctcaaggcatttgtccgcgaaagcaaatcactgagtaacaagaaaaaggagtatttactgacagaagaggacatatcccggttcgatgtgagaaagaagtttattgagaggaatctagtagacacccgctacgcgagccgagttgtgctcaacgctctgcaggaacatttccgggcccacaagactgacaccaaagtctctgtggtccgtggacagtttacatcacaacttagaaggcattggggcatcgagaagacccgcgatacttatcaccaccatgcagtggacgccttgattatcgctgccagtagccagctgaatctctggaaaaagcagaaaaacacactggttaattactccgaaaaccagttactggatatagagacgggggagcttatctctgacgatgaatataaggagtcggtgttcaaggcaccttaccaacacttcgtagacaccttgaaaagcaaggaatttgaggattccattctcttctcatatcaggtcgacagtaaatttaatcggaagatctctgatgctactatttacgccacaagacaggcgaaagtgggaaaggacaaaaaggatgaaacctacgttctgggtaagatcaaagacatatatagccagacaggctacgatgccttcattaagatctatcaaaaagacaagtccaaatttctaatgtacaggcatgacccacagactttcgagaaggtgatcgagcccattctggaaaactatcctaacaaggagatgaatgaaaaagggaaggaggtcccatgtaacccctttctcaaatacaaggaggaacacggagattatatccgaaaatactcaaagaagggcaatggtccggagattaaaagcctgaagtactatgactctaaacttgggaaccacatagatatcacccctaaggactccaataacaaagtggtattgcagagtgtgagcccctggcgcgctgatgtttacttcaataagacgaccggcaagtatgaaattctgggattaaaatacgcagacctccagtttgagaagggcacagggacttataaaatctctcaagaaaagtacaacgtcattaaaaagaaggagggagtggattccgactcagagttcaaatttaccctgtataagaatgatcttctgttgatcaaagacacagaaactaaggagcagcaactcttccggtttctgagtagaaccaaaccaaacgtgaagcattacgtcgaactaaaaccttacgataagcaaaagttcgagggtaatgaaagcctgataaacgttctcggcgccgtggctaaagggggacagtgccagaagggcatcaataaacccaacatttcgatctataaggtgaggacggacgtactgggtaatcagcacattatcaaaaacgagggggacaagccaaaacttgatttctga

SEQ ID NO: 2811 - RNA, 3387 nt, synthetic construct
  misc_feature 1..3387: note = Cas9 variant
  source 1..3387: mol_type = other RNA
atggacgagaagatggattacagaatcggcctggacattgggatagccagcgtgggatgggctgtcctccagaacaattccgatgacgaacccgttaggatcgtggatcttggtgtacggattttcgacaccgcagagatccctaaaacaggcgaatctctggccgggccacgccgagcggctcgtactacgagaaggcggttgcgcagaaggaagcaccggttagatcgcattaaatggctgtttgagaaccaaggactaatcaatatagacgatttcctcaagcgatataacatggccggcctgccggacgtgtaccagcttagatatgaagcactggataggaaattgaccgacgaggagctcgcccaggtcctgctgcatatcgctaagcaccggggttttcgttcaacacgcaaggcagaaactgccgctaaagagaatggggccgtgctcaaggcgaccgatgaaaaccagaaaagaatgcaagagaagggatacaggacagttggcgagatgatttatttagacgaagcattccggaccggctgcagttggagcgagaaagggtacatcctgactccccgaaataaggccgaaaactatcagcatacaatgcttcgcgctatgttggtggaggaagtcaaggagatcttttcctctcagagaaggctgggaaatgagaaagccaccgaagaactagaagagaagtacctcgaaattatgacgtcgcagcggtcattcgacctgggtcctggcatgcaaccagatgggaaacccagcccttacgcaatggagggatttagtgaccgcgtgggcaagtgtactttccttggtgatcagggggagctgagaggagctaaaggcacctatacagccgaatactttgtagcgttgcagaagataaaccacactaaactcgttaatcaggacggcgagaccaggaacttcacagaagaggaacgtcgggccctgaccttactgctctttacgcaaaaggaggtgaagtatgcagctgtccgaaagaaacttgggctgccagaggatattttgttctacaatctaaactataaaaaggccgctactaaagaagaacagcagaaggaaaatcaaaacacagagaaggccaaatttatcggaatgccctactatcatgactacaagaaatgcctggaggaaagagtgaagtacctcaccgagaacgaagtgagggatctgttcgacgagattggtactatccttacatgttataaaaatgatgactcccgcaccgaacggctggcaaagttgggcctcgtccctatcgagatggaggggctgttagcctacacgccaaccaagttccagcacctgtctatgaaagctatgagaaacattataccgtttctagaaaagggaatgacatatgataaagcgtgcgaggaagcaggctacgacttcaaggccgacagcaaaggtatcaagcagaagctcctgactggggagaaagttaatcagaccattaacgaaatcacaaatcccgtggtaaagaggtccgtgtcacaaactgtcaaagtgataaacgctattatccgcacctatggcagtcctcaggccatcaatattgagcttgcacgagagatgagcaagacatttgaggagcggcgtaaaatcaagggagatatggagaaaagacagaagaacaatgaggacgttaagaaacagattcaagaattgggcaagctgtctccaaccgggcaggatatactcaaatacaggctgtggcaggagcagcaaggaatctgtatgtattccggtaagactattccccttgaggaactgttcaaacctggctacgacatcgatcacatcttgccatactcaattacgtttgacgatagcttccgcaacaaggtgctcgtcacaagtcaggagaatcggcagaaggggaacagaaccccctatgaatacatgggaaatgacgagcagaggtggaacgagtttgaaactcgagtgaaaaccacaatacgcgattataagaaacaacagaagctgctgaaaaagcatttctctgaggaggaacggtccgaatttaaggagagaaatttaaccgacactaaatacatcacaacggtaatttataacatgatcaggcagaacctagagatggccccgctcaatcgtcctgaaaagaaaaagcaagttcgcgctgtgaacggcgccattaccgcatacctgcggaaaagatggggtcttccccagaagaatagggagactgatacacaccatgcgatggacgctgtcgtgatcgcctgctgtaccgatgggatgatacagaagatcagccgatatacaaaagtccgggaacgctgctactcgaagggcactgagttcgtggacgcagaaaccggagagatttttagaccagaggactactctagggccgaatgggatgagatcttcggcgttcacattcctaaaccctgggaaacgtttcgggctgagttggacgtgcgaatgggggatgacccaaagggattcctggatacccactccgacgtagccctcgaactggattatcccgagtacatctatgagaacttaagacctatattcgtctcacgcatgccaaatcataaagtgacaggtgcagctcacgccgacactattaggagtccgcgtcattttaaggatgaaggcatcgttctgaccaaaacagcgcttactgacttgaagctcgataaggacggggagattgatggatactataacccccagagcgacctgctactgtacgaagccctcaaaaagcaactgcttttgtatggcaatgacgctaaaaaggcattcgcccaggattttcacaaacctaaggctgacggtaccgaggggccagtggtccggaaggtgaaaatccagaagaaacagacgatgggcgtattcgtggattccggaaacggcatagccgagaatgggggaatggttagaatcgacgtctttcatgtgaacggcaagtactacttcgtgcccgtctatacagcagatgttgtgaaaaaggtgctgcctaatagggcggccaccgctcacaagccatacggtgaatggaaagtaatggaggacaaggactttttattctctctctatagccgcgatctgattcacatcaaatcaaagaaagatattcccatcaagatggtcaacgggggaatggaaggcataaaggagacttacgcctattacattggtgcagacatcagtgctgccaatatccaaggcattgcacatgattcccgatataaatttagagggcttggaatccagagcctggacgtgttggaaaagtgtcagattgacgttctcggccacgtgtctgtcgtgcggtcagagaaaaggatggggttcagttga

SEQ ID NO: 2812 - RNA, 3387 nt, synthetic construct
  misc_feature 1..3387: note = Cas9 variant
  source 1..3387: mol_type = other RNA
atgagcgacctggtgctcggccttgatatcgggattggatccgtcggtgttggcatactgaacaaggtgaccggggagatcgtacacaaaaatgccagaattttccccgctgcacaggccgaaaacaatgtggagaggcggacaaaccgccaaggacgacgtttgactagaaggaagaaacatcggcgcgtcagattaaatcacatctttgaagagtctggcctgattacggacttcaccaaggtgtcaatcaacctaaatccttaccagctcagggttaaaggtctgacagatgaacttagtaacgaggagctgtttatagcgttgaagaatatggtgaagcatcgggggatcagctatctcgacgatgcttccgacgatggaaactcttcggtcggcgactacgcccagattgtgaaagaaaattcaaagcagctggagactaaaaccccaggccaaatccagctggaacgctatcagaagtacgggcagctccgaggagatttcacaattgaggaggacggtaaaaagcacagattaatcaacgtatttccgaccagcgcatatagggccgaagctctgcggatacttcaaactcagcaggagttcaatccccagattacagatgaatttatcaacagttacttgcaaattctgaccggcaagcgtaaatattaccatgggcctggaaatgagaagtcccgcacggactacggcagatatactaccaaaaaggattctgaagacgagtacatcacactagacaacatcttcggtattctcatagggaaatgcactttttatccagaggaatacagggcagccaaggctagctataccgcccaggagttcaacctgcttaatgatctgaacaatttgacagttcccaccgaaacgaaaaagctctccgaggaacagaagaaccaaatcattacttacgtgaaaaatgagaaggcgatgggacctgcaaaactgtttaagtatatcgccaaattactggcttgtgacgtcgccgatataaagggctaccggattgacaagtcagataaaccagagatccacacattcgaagcataccgaaagatgaaaaccctcgagactatcgacgtggaacagatggagcgcgaaaaacttgataaactggcttatgtgttgacactaaacaccgagagagagggcattcaggaagccatcgagcacgaatttagtgacgggacgttcagccaggagcaagtcgatgagctggttcagttcaggaagtctaattcctcaatttttggaaagggttggcataacttcagcgtgaaactcatgatggaactgatacccgagctttacgcgaccagtgaagaacagatgacaatcctgactcggttgggcaagcagaaacgcacctcttccagcaataagacaaaatatattgacgaaaagagactcactgaggagatctacaaccctgtagtggccaagtcggtcaggcaagcaatcaaaattgtgaatgctgccataaaggaatatggggattttgacaacatcgttattgagatggctcgtgaaatgaatgaggacgatgaaaagaaggccatcaaaaagattcaggaggcaaacaaatctgagaaggacgccgctatgcggaaggcggcaaatcagtacaacggaaaagccgaactgccacactccgtgttccatggccacaagcagttagctaccaaaatccgactgtggcaccaacagggtgagagatgcctatatacagggaagaccatatcaatccatgatctcattaacaatccgaaccagtttgaaatcgaccacattctgccccttagtatcactttcgatgacagcttggccaataaagtcctggtgtacgcaacggccaaccaggagaagggccaaaggacaccttaccaggctctcgattccatggacgatgcctggtcttttcgcgaactgaaggcattcgtacgggagagcaaaaccctttcaaataagaaaaaggagtatctgttgactgaagaggacataagtaaatttgatgttagaaagaagttcattgaaaggaacctcgtggacacccgctacgcgtcccgagtcgtgctgaatgctttacaggagcattttcgggcccgtaaaatcgatacaaaggtcagcgtggttagaggacaattcacctctcagctgaggcgccactggggcattgacaaaactcgggacacatatcatcaccacgcagtggatgccctaatcatagctgcctcaagtcagctcaacctgtggaagaaacagaagaatacgcttgtaagctactccgaggaccaattgctggatatcgaaaccggggagctcatttctgacgatgaatataaggagtcggtctttaaagcaccataccagcatttcgtggacactttaaagagcaaagagttcgaggattccatcctgttttcatatcaggttgacagtaagttcaacagaaaaatttctgatgctacaatctacgccaccaggcaggcgaaggtgggaaaagacaagaaggatgagacatacgtcctgggtaaaataaaggacatttatagccaagccggctacgatgcttttatcaaaatctatcagaaggacaaatccaagttccttatgtaccgacacgacccccagacttttgaaaaggtgattgagcctatcttggaaaattatccaaacaaagagatgaatgaaaaggggaaagaggtaccctgtaacccgttcctcaagtacaaagaggaacatggagattatattcgcaagtactcaaagaaaggcaatggtcctgagataaagagcctgaaatactatgactctaagctagggaaccacatcgatattacccccaaaaactccaataacaaggtggttctgcagagtgtcagcccatggcgggcagacgtgtactttaataagacgaccggcaaatatgaaatcctcggactgaagtacgccgatcttcaattcgagaaaggcacagggacttataagatttctcaggaaaaatacaacgacatcaagaagaaagagggagtggattccgactcagagtttaagttcaccttgtataaaaatgatctgttactcataaaggacacagaaactaaagagcagcaactgtttagattccttagtaggagcatgcctaacaagaaacactacgtcgaactgaagccctactcgaaggataaatttgagaagaatgagaccttgatcgaaattctcggtccaacggacaaatccggccgttgcatcaaggggctggctaaatctaacctaagcattttcaaggttcgcacagacatcctgggaaatcagcatataattaagaacgagggcgataaacccaagctcgacttctga

SEQ ID NO: 2813 - RNA, 3387 nt, synthetic construct
  misc_feature 1..3387: note = Cas9 variant
  source 1..3387: mol_type = other RNA
atgaccaagatcctgggcctcgaccttgggacaaacagcattggatgggccgtggtcgatgagaaaaaggagaaaatactgggtatgggctccagaatcttccccgaaggggttgtgaatattggagaaggcgagggtagggaaacttctaagaacgcttcacggacggacgcacgcgggacccgacgtcagtttttcagaaggcggttgcgcaaaagatacttactgagggagctagccaagaagggactctgccctatcaattatacactggtaaaagagtggaacgaagcgcaaatttttaagaataaacagcttcaggagtggttcaagctgaacccatacgaattgcggagtaaagctatccaggagaagataagcctcgaggaactgggccgcatcttttatcacttcattcaacgaagaggctttcagtccaattctaggtcggccggggtggataacatcgagaagtcagtcattttcaaaggagacactaagaccggtaaaatcggcataagcgaaacactggagagtattaagaataccaaaactctcgggtcctacttacatacaatctatccgaagcagaacaaaccctactctggacacaaggaacggattcgtaatcgctataccacgagacagatgtacatctacgagtttgagactatctgggaatatcaaaagcagttctacagcgagctgtccaacgaacttaaaaccgtgttgggcggtaggaagaaagatgggtataaggaggacgggattctgtttcatcagcggcctctacgatcacagaaacacctcgttggctactgtagtttcgaaccaaagaagacaaaatgccaaataaatactatcccctttgagctgttccgcatttatcagtgggtgaacaccgtcgattgtaatgagaaggtgacaagcgaagacagaggcaaaatggtagagcttctgttgtctaaggaaaaagtttccttcaaggagatcaggaaggtgataaacaaatcagatgggtactatcagtttaactacaagaatgacgataaaattgtcggaagctacaccatcagtaacctctctaataagaaattctttggtaagaagtggttcgacttttccgataaagaacaagaggacatctggcatgtgctgagcttctttgacgatcgggacaagttaaaacagtatgcaattaagtactggggcttcaacgaggaaaaagccgtgaagatctcgaaatttaatctgaaggaggggtattctaacctctcccgcaaggctattcacaatatacttcctttcctgaaattgggatttatgtacgatgtcgcagttggcctaggtggggtgaagaacgccctggctgacaaatggatcgaaaatgagcagttcattctcgataacgtaccatcagtggtcagaagtaattttaagggcggatatatcgagcccctgaaacagatgcttaagtacgagttcgacgtgagcgataagcaactgttgaaactctatcaccattcctctgccatcgaaacgactgaactgttaaagaaactgcctattaacagcgaggcggacaaggaaatacagtcaatcaaaaatccagttgtgattacagcactattcgagatcaggaagctcgtcaacgagattatcgatacctacggcaagtttgacgaaataaaagtggagctggcccgtgatcttaaggctagtaaatccaagcggtacgacactcgaagagaacagttgaggctggagaaagaaaatgaccgcatcaagattgagctcgagaacctggggcagcggatcaaccacattacaatccttaagtataaactgtgggaagagtgcgataagagatgtccgttcaccggtaaaaatatagaagtaaacgagttgtttagcggagaagttcaaattgagcatatcttcccctggtctaggtcactcaatgacagttttatgaacaagacgctgtgcttcgccgatgagaatcgcgcaaaaggcaacaagaccccttacgaattttatagcgagcagggggaacagaaatgggaggagattaagatccaggctttatcctgtttcaagaataaaccaaactaccccaatgcctatcaaaagtttaaacagttcgtgaagaaaaagcacgacgaagattttatatctcgacagctgaacgacacacggtacatctcgaaggaggcgaaaaattatctaagcaagatttgcaacaatgtccaggtggcccctggacaaatgactgcaaccctccgtcacaaatggggcctgaacacaatccttaataaggatgacgatactaaaaccagagacgatcataggcaccatgctattgacgccttggtcatggcttgttccacacgctcacatctgcaggaactcagtaagcggaacagataccagaaggattacgagttcaaagactttccaatgccctggcaattcttcaggcaggacgccgaaaagtctgtggagcagatcctggttagccacaaaaagttaaacaccatactgactgtgcgaacgcacaaaacaaagaagaatggtgtagtctataaaaacattggggtggcagcccgcggccagcttcacaaggagaccgtttttggaaaacggactgctccggatggcatcgaagcgtaccatgtgagaaagcctatcgagtccttgtcaacccacaaacatattaataaggtcgtggacgaaacaatcaggctcctgattctaaagcaagtaaacaaactgggaggattcgtgaagggtaaaatacccgagggcaccttttataatactgatgaaaacgggaataagcagccacagatcttcctccctaacaaaaatggaaaccccgttccaattaagaaaatccgtctgcgcgagaatattggcggtgcagagcagcttaagagcacagtcaaccaacacgtgaatccccggtctaaccaccatgtgttgatctacaaggactttgatgacaatctgaaagaaaaggtcgttacgttctggaccgccgtggagaggaaaaagcagaaacaggctgtgtttcagttacctgaaaacgggaaggagatagtaactacactccaaatcaacgatatgttcctgcttggcctgaaggacgatgaaattaattgggagcacccaaaatttaccttgctcaaggagcatctgtatagagtccagaaattcacatccggagactactattttcgaaagcacatcgaaagtaacctaaatggcgagctggggaaagcctaccagtacattaagggattcggcgaaggtaagactgggtggaaaaccttcaacccgatcaagataaaagtgagcgtttctggaaagattgagaaagtgtga

SEQ ID NO: 2814 - RNA, 3390 nt, synthetic construct
  misc_feature 1..3390: note = Cas9 variant
  source 1..3390: mol_type = other RNA
atgaacggcctggtgctcgggcttgacatcggaattgccagcgtcggtgctggcatactgaagaaagataccggggagatcattcacgcaaattccagattgttccccgccgcgacagctgacaacaatgttttaaggcggtcttcacgccaggcccgacgtagtactagaaggaagcggcatcgcgcagtgagactgcacgatctatttgaagactacggactcctgacggatttcagcaaagtatccatcaaccttaatccttataagctgagggtggagggcatggacattcaattgaccacagaagaactctttatcgccctgaaaaacataatcaagcggcgcggtatttcttacctggatgacgcttcggaagatggggtcactgtgtcaagcgactatggaaaggcagttgaggagaatcgaaaactcttaagtgaacagaccccaggccagatccagctggagagattcgaaaagtacggccaagtgaggggagattttacagtcgaggagaacggggaaaaacggcgtcttattaatgtgttctccacctctacttatcgcaaggaggccgaaagaatcttgaggaaacagcaggagtttaacaataagataacagacgatttcattgacgactacctgaccatcctaacgggtaagcggaaatattaccatggcccggggaacaagaaaagccgaactgattacggacgctataccacaaagaaagactccgaaggcaagtacattactctcgataatatctttggtgtactgatcgggaaatgcaccttctatcccgacgagtacagagcttcaaaggccagttatacagcgcaggagtttaaccttctgaatgatttgaacaacctcaccgttcctacggaaactaagaaactgagcgagaagcaaaagaagacaattgtggaatacgcaaaaaccgccaagactttaggagcttctacactgctcaagtatatagccaaaatggtcgacgcatccgtggatcagatccacggctacagggtggacgtcaataagaaaccagagatgcataccttcgatgtttaccggaagatgcagtcacttgaaacgtttaacgtgaatgagatgccccgcgaggtactggacgaattggctcacattctaaccctgaacacagagagagaaggcatcgaggaagccataaatactaaactcaaggggaccttcaaccaggatcaagtgctggagcttgtccagttcaggaagaataacagcagtctgttttctaaaggatggcacaatttctccttgaagctcatgatggagctgattcctgaattatatgcgacaagcgaggaacagatgactatcctgacccgtctaggtaaacaaaagtcgaaagagatctctaagcggacaaagtacattgacgagaaagaaatcaccgaggaaatttataacccagtggttgccaagtccgtgcgacaggcaataaaaatcattaatgaggctactaagcagtacggcatctttgaccatatcgtcattgaaatggccagactcacgaacgaggaggatgctaaaaaggactatataaaaaggcagaaggccaatctggatgaaaagaacgcagccatggagaaagctgcgttccaatacaatgggaagaaagaacttcccgactcaatctttcacggacataaggagttggcaacaaaaattcgcctgtggcaccagcagggcgaaaagtgtctctataccggtaagaacatccctattagtgatctgatccagaaccaatacaaatacgagatagaccacatccttccactgagcttgtccttcgatgactctctcagcaataaggtgctggtattagccactgctaaccaggagaaagggcagcggaccccgtttcaggccctggatagaatggacgatgcatggtcatatagggagttcaagagttacgttaaagactccaagctactcggcaataagaaaaaggattatctgcttacagaggaagacattagcaaaatcgaggtgaagcaaaaatttattgaacgcaacttggtcgacacccgatactcttcacgggtggtcctgaatgccctccaggatttctataagaaccatcactttgacactacaatcagtgtggttcgtggacagttcacgagccagctgagaaggaagtggggcttagagaaatcccgcgagacctaccatcaccatgctgtggatgccctgataattgcagcgtcttcgcaacttcggttgtggaagaaacagaataaccccctcatcttttataaggaagggcagttcgtagacagcgagactggagaaattctgtccctaaatgatgacgagtacaaagagctggtcttcaaggctccttacgatcactttgtggacacactcagatcaaaaaccttcgaagatagtatcctgttttcttatcaagttgacagcaagtacaacaggaagatatccgatgccacaatctatgcaactcgaaaagccaaacttgacaaagataagtcaaaagagacctacgtgttgagcaagattaaggacatctattctcaggctggttacgacgccttcattaaaatctataataaggataaatccaagtttctgatgtaccacaaagacagtcagacgttcgaaaaggtcatagaggaaattttacgcacctacccaagcaaggagtttaacgataaaaataaggaggtgccctgcaaccctttcgaaaaatatcggcaggagaatggcccaatcagaaagtactctaaaaaggggaacggacccgaaatcaagtccctcaaatattacgacaagaacattccggagtcatttatcaatattacacctagtaacagcaaaaataaggtaatactgaggcaacttaacccctggcgtactgatgtgtatttcaatcatcagaccgaaaaatacgagctgttgggcctcaagtatgcagacctgcagtttgagaagaaaacaggtacttactcgatcaccattgataagtacaacgaaatcaaagagaaggaaggggttggcgagcagtccgagttcaaatttacgctatataagaatgacctgctcctgattaaagatacaaagaacaatgaaaagcaaatcttccgcttcctttctcggaccatgccaaacgtcaaacactacgtggagttgaagccttataataaagctaagtttgacggaaaccagcccctgataactatcttcggcaatgtggccaaagggggacagtgtttaaagggtctcaacaagccaaatattagcatctacaaaattaagacagatgtcctgggcaacaaatattttatcaagaaagaaggggacaagcccaaacttaagttctga

SEQ ID NO: 2815 - RNA, 3390 nt, synthetic construct
  misc_feature 1..3390: note = Cas9 variant
  source 1..3390: mol_type = other RNA
atggccgacagaatcagcctgggcctcgatattggggtggcttccgtcggattctctgttcttgacatagataagggtaaagtgatcgagctgggctcaaggttgtttaacgcaaccgtagccgaagggaatcaggaccggcgcagtatgcgaggagcgcgtagattactgaacaggaataagcaacggcgccaggatacaggcaaactattccagaagtttggtctcctggacaacttcaataaagataacttttacgacactttcaatcagaactggaatccctatgagcttagagtgaaggggctgacggaacacttgaccaagaaagagctcgctgaaagcctgtaccaaattgtcaagcataggggaatctcctatgccctgaaagatgcagacgccgatgagggcggcacagactactctgcttcgctcaagattaactcacaggagttagcagagaaaactcctgcccagatccagctgcaacggcttaatgattatgggaaggtgcgcggacaggttgtgataggtgacgacccagataaccagaaggtcttgctgaatgtgtttccgaccagcgcttacgagaaagaagccaagcagatcattgcgacacaaaaacagttctatcccgagatcctaaccgacgagtttactaaggaatactgcaaaattctcacacgaaagagagattacttcgtaggccctgggaacgagaaaagtaggaccgactatggaatctacaagacggatggccggactctggacaatctttttgaagaactgataggtcacgataagatttatccagacgaattgcgtgcatccgccgcttcttacaccgcccagctctttaacgttctgaacgatttaaataacctgcgcatcctcagctatgaggacgggaaacttacaaaggaggataaagaaaagattatcgcagagatcaaatccaatactaccacaattaacatgctgaatgtgataaagaaggtcgctggatgttcaaaagaagacatcaagggctttagagtgaacgagaaagacaagcccgaaattagtagcatggccgtgtacaggaaagtccataaggatttgctaaaggttggcgtggacatctctgattggcctgtagagttcatagacaaactgtccttcattctcaccctgaatacggagaacggggaaatccggaagcaacttaataaccgactggtgccagagtttgatttcttgaatgacgatctcatccagctgattatcgacaacaaagattcatttgaaattaagactaataacaaatggcaccgcttcagcttaaagacaatgaataagctgatgcccgagatgctagaaagacctgtcgagcagatgaccctcctgaacgagatgggacttgtgaaaaaggacaaaaagaggtttgaaaacaataaatatttgccatacaaggagatagcgaaagatatcttcaacccggttgccagtaagtctgtgcgggaagcactgaagattgtcaatgctgtgctcaaaaagtacggtcatatcgactatctggtaatcgagatgccccgcgataaaaaccttaaggaggaacaggacaatattaaagagtttcaaaacaagaataagaaagccaaggacgctgccttcgaagcatttgttaaatccgtgggcagcgagcagagagtcaaggaagccctgtcgaaaaacaggaagttgcagatgaagatgcgtctctggtaccagcaacaggagatagatccttataatggggagactatcgacgctacagatctgattaacaatccagacaaattcgaaatcgatcacattatcccccagtctatatcctttgacgattcaatcaacaataagaccttatgcttcgcgagtatgaaccaggtgaaaggacaaaagacgccttacgagtttatgctggaaggccacggtcaggggtatgacaaattcaaggcaaccgtcctagataataagaacttcgaccggaacaaacgaaagaattacctctttgaggaaaacgtgagcgatattgagacaagaaaaaggttcctgtcccgcaatcttgttgacactcggtattctagcagagtggtattgaactcactgcaggatttcttccatgagaagagtgccgacaccaaagtcacagtgatcaggggcaagtttacttccaatatgcgcaaacactggcatattgacaagacccgagaaacattccaccaccatgctatcgatgccagcataattgcagccaccccatttctccggatgtggaagaaaggaggcactatcttccccgttaaggtgggggaggaatctattgacatcgagacgggagaaatactggatgacaaaaagtttgataaagtcatgtacgaggagccgtacaacggtttcgtgtcagaaatcatgaatgctgacgatcgtattaagtttagtcaccaggtagacaagaaaatgaacagaaaggtgagcgatgccacaatctattccaccaggactggcaaattagcaaaggacaaaaaggatgcggagtacattgttgctaaggtcaaagacatctattctgtggacgggttcaagaaatttaagaaagtgtacgataaggacaagtcgaaattcctgctttataagtacgatcctcgcaccttcagcgaattggagcggataatttccgactgtcccgataaagtcgagaaggttcaaacaaatggaaaagtgaaggccgtggacgtatcaccatttgaaatgtatagaaggtaccatggcatgatcaagaaatacagtaagaaaggtaacgggcctgcaatcaagcagctcaaatatctggataagaaactaggctctcacattgacatcacccccgccaatgctaacggaaagcatgtcattctgcagagcctcaagccatggcgaactgatgtgtacctgaatcacgagacaggcgaatatgagataatggggatcaaatactccgaccttaagttcaacaaaaatgttggatatggtattaagaaagataagtacttggaaatcaagaaaaacgaggaggtgtcagaaaagagcgagtttatgttctctctgtatcgcaaagaccgggtcaggattcaaaacatgaagacgggcgaatccgtggagttactcttttggagtagaaatttcagcaacaaaaagtacgccgaactgaagcccatctttaaattcgttaccgaggatgacgactggcctgtgtacgggcacgcaaagactcagatacttaaacgtctggtaccaaaggattgcaaaatctggaaggtcaatacaaccattttgggagacccgtattacctcgagaaggaatctgataaccccaaagacatcctggattga

SEQ ID NO: 2816 - RNA, 3390 nt, synthetic construct
  misc_feature 1..3390: note = Cas9 variant
  source 1..3390: mol_type = other RNA
atgaccaacggcaagatcctggggctcgacattggaatagccagcgtgggtgtcggcatcattgaggctaaaacagggaaggttgtgcacgcaaattccagacttttctctgccgcgaacgctgaaaataacgccgagaggcggggatttcgcggctcacgacgtctgaatagaaggaaaaagcatcgggtaaaacgcgtgagagatttgttcgaaaagtacggtatcgtcactgactttaggaacttaaatctgaacccctatgagctacgggtgaaggggctcacggaacagctgaccaatgaggagcttttcgcagccctgcgcacaattagtaaacgaagaggaatcagctacttggatgacgctgaagatgactccactggctctaccgattatgcaaagtcgatagacgagaacaggcggctcctgaaaacaaagacccctggccaaatccagctggaacgtctcgagaaatacgggcagttacgcggaaattttactgtttatgatgagaacggtgaagcccacagactgattaatgtgttctcaacaagcgactacgagaaggaagctaggaagatccttgagacccaggccgattataacaaaaagattacggcggaatttatcgacgattacgtcgagatattgactcaaaaacggaagtactatcatggcccagggaatgagaaaagtcgaaccgactacggacgcttcagaacagacggcactaccctggaaaacatttttggtatcctaattgggaagtgctccttctatccggatgagtacagggcatctaaagccagctatacagctcaggaatacaactttctcaatgacctgaacaatcttaaggtgcccaccgagacgggaaagctgtccactgaacagaaagaggccttggtagagttcgcaaagtcaacagctaccctcggccctgccaaactgttaaaggaaatcgcgaaaatcctggattgtaaggttgacgagattaagggctatcgggaagatgacaaagggaagccagatctccacacttttgagccctaccgcaaacttaagttcaacctggacagtgtgaatatagatgacttgagcagagaagtcctagataaactggccgacatcctcacactgaacaccgagagggagggaattgaagacgcaatcaagcgtaatcttcctaaccagttcacggaggaacaaatatctgagattatcaatgtgcggaagtcccagtcaaccgcttttaacaaaggttggcatagcttcagtgccaagctgatgaatgagttgatcccagaactctacgctacatctgatgagcagatgactattctgacccgattagaaaaatttaaggtgaaaaagaagtccagcaaaaacatcaagacaattgacgagaaagaaataactgatgagatctataatcccgtcgttgccaagtcggtgagacagaccattaaaatcatcaacgcagccgtaaagaaatacggcgacttcgataagattgtgatagagatgcctagggacaagaatgctgatgacgagaaaaagtttatcgataaacgcaacaaggaaaacaaaaaggaaaaggacgatgcgctgaaacgggcagcctatctatacaatgggacagacaagctcccagatgaggtcttccacgaaaacaaacaactggagaccaagattagactttggtatcagcagggagagaggtgcttgtactctggcaaaccgatccccattcaagaactggtgcacaattccaacaattttgagatcgaccatatactccctctgtcacttagtttcgacgatagcctggctaacaaggttttggtgtattcctggactaatcaggaaaagggtcagcgcacgccataccaggtcatcgactctatggatgccgcatggagctttcgagagatgaaagactacgtgctcaagcaaaaagggctgggcaagaaaaagcgggattatttactgacaaccgaaaacattgacaagatcgaggttaaaaagaaattcattgagcgtaatctagtagatactagatacgcctcaagggtggtcctcaacagtctgcagtccgcccttcgcgaattgggaaaggacaccaaagtgagcgtcgtgcggggccagtttacatctcagctgagaaggaagtggaaaatcgataagtcacgagagacctatcaccatcacgctgttgacgcactcataattgcggctagtagccaactgaagttatgggaaaaacaggataatcccatgttcgtggactacgggaacaatcaggtagtcgataagcagactggagagatcctgtccgtgtctgacgacgagtataaagaacttgtttttcaacctccataccagggtttcgtgaacacaatttcgagcaagggcttcgaggatgaaatcttgttttcctatcaggtcgactcaaaatacaatcgcaaggtgagtgatgccacgatatactctacccggaaggcaaaaatcgggaaggacaaaaaggaggaaacttatgtactcggaaaaattaaggatatctacagccagaacggcttcgacacatttgtgaagaaatataacaaggataaaacccaattcctgatgtaccagaaggaccccctaacatgggagaatgttattgaggtcatcctgagagattatccgactaccaaaaagtccgaagacggtaagaacgatgtgaaatgtaatccttttgaggaatacaggcgtgagaacgggctcatatgcaagtatagtaaaaagggcaaaggaacgcccattaagagcctgaagtactacgacaaaaagttgggcaattgtatcgacatcaccccacaggaatctaaaaaccgcgtggtccttcggcaaatttccccttggagagccgatatctatttcaatcccgagacactgaagtacgagttaatggggctcaaatatagtgacctgagctttgaaaagggaactggtaaataccacatttctcaggagaagtatgatgctataaaggaaaaagagggcgttgggaaggactccgagttcaaatttaccctttacaggaacgatctgatcttgattaaggacacactcaataactgcgaacgaatgctgcggttcggaagcaaaaatgatacttcaaagcattatgtggagctaaagccactggaaaaaggcacctttgactcagaggaagagatcctccccgtgctgggtaaggtagccaaatcggggcagttcattaagggccttaacaaacctaatatctccatatacaaggtccgcacggatgtgttgggaaacaagtactttgttaaaaaggagggcgacaaaccaaagctggatttcaaaaataacaagaagtga

SEQ ID NO: 2817 - RNA, 3390 nt, synthetic construct
  misc_feature 1..3390: note = Cas9 variant
  source 1..3390: mol_type = other RNA
atgagcaacggcaagatcctggggctcgacattggagtggcctccgtcggtgttggcataatcgattctaaaaccgggaatgtgattcacgctaactcaagacttttcagtgcagccaatgcggagaacaatgctgaaaggcggggatttcgcggcgcccgacgtctgacaagaaggaagaaacatcgggtaaagcgcgtgagagacttgttcgagaaatacgatatcagcactgactttaggaacttaaatctgaacccctatgaactacgggtcaagggtctcacggagcagctgaccaatgaggaacttttcgcagccctgcgcacaattgctaagcgaagagggatctcctacttggatgacgcagaggatgactctactggatcgtcagattatgccaaaagcatagacgaaaacaggcggctcctgaagaccaaaacacctggccaaatccagctggagcgtctcgaaaagtacggccagttacgcgggaattttaccgtgtatgatgagaacggagaggctcacagactgattaatgttttcagtacttccgactacaaaaacgaagccaggaagatccttgagacacagtctaattataacaagcaaattaccgatgaatttatcgaggactacatagaaattttgacgcagaaacggaagtactatcatggtccaggcaacgagaaaagccgaactgactacgggcgcttcagaaccgatggaacaactctggagaatatctttggcattctaatcggtaagtgctccttctatccggaagagtacagggcgtcaaaagcaagttataccgcccaggaatttaacttcctcaatgacctgaacaatcttaaggtgcccacagagaccgggaaactgagcacggaacagaaggagtacttggtcgattttgctaagaaatctaaggccctcggagcatccaaactgttaaaggagatcgctaaaattgtggactgttcagtagatgacataaagggctatcgggttgataacaaggacaaacctgatctgcacactttcgaaccataccgcaagctcaaattcaatcttagcagtatcgacattgatgagctgtctagagaaacattggacaagctagccgacatcctgaccctcaacactgagagggaaggcatagaggatgcgattaaacgtaatctgccctcccaatttacagaggaacagatcagcgagatcgtgcagattcggaagaaccagtcgtctgccttcaataaggggtggcattccttttcagcaaaacttatgaacgaactgatccctgagttgtacgtcaccagtgaggaacaaatgacgattctcacccgactggagaagttcaaagtgaataagaaaagctccaagaacacaaagactatagacgaaaaagagatcaccgatgaaatttataatccagtggtcgctaagtctgttagacagacaatcaaaatcattaacgccgctgtgaagaaatacggagactttgataagatagtaatcgagatgcccagggacaaaaacgccgaggatgaaaagaagttcattgacaaaaagcagaaagagaataagaaagaaaaggatgacagcttaaagcgcgcagcctttctgtataacggtactgataatctacctgacggcgtgttccacgggaacaaagagctcaagaccaaaatccggctgtggtaccaacagggagaaagatgcctttattcaggcaagttgattagtatccacgatctggtccataattccaacaaatttgagatagaccacatcctcccactgagcctttctttcgacgattcactggctaataaggtgttggtttacgcgtggacaaaccaggagaagggtcagaaaaccccgtatcaagtgattgacagtatggatactgcatggagctttagggaaatgaaggactacgtcctcaaacagaaggggctgggcaaaaagaagtgtgagtacttactgacgacagaaaatatcgataaaattgaggtgaagaaaaagttcatcgaacgcaacctagtagacacccgatatgcctcccgggttgtgctcaattctctgcagactgctcttaaagagttgggaaaggataccaaagtctcggtggtccgtggccagtttacaagccaactgagaaggaagtggaacatagacaagtcccgcgagacctaccatcaccacgccgtggatgcactcattatcgccgcttcaagtcagctgaaattatggcagaagcaggaaaatcccatgttcgagtcttatggggaaaaccaagttgtgaataaagagactggagagattctgagcatctccgacgataagtacaaagaacttgtattccagcctccatatcagggttttgtcaacacaatatcaagcaagggcttcgaggacgaaatcttgttttcttaccaggtggattccaagttcaaccggaaagttagtgacgccacgatttatagcaccagaaaggcaaaactcgggaaggacaaaaaggatgagacttacgtgctgggaaagatcaaagacatttactctcaagatggctttgacacattcatcaagaggtataaaaaggataaaacccagtttctaatgtaccagaaggaccccctgacatgggaaaatgtcatagaggtgattctccgagattatccttccgagaagctgtcagaagacggtaaaaagactgtaaaatgcaacccattcgaggaataccgccgggagaatgggcttatctgtaagtatagtaaaaagggcaacggaacccccatcaagagcttgaaatactatgataagaaactgggcaattgcattgacatcacgccggaaaagtcgaaaaacagagtggttttaaggcaaatttccccttggcgtgcggatatatactttaatctcgagaccctgaagtacgagcttatggggctgaaatattctgacttgagcttcgaaaagggaacaggtaagtaccatatctcacaggagaaatatgacgctattcgcgaaaaggagggcatcgggaaaaagagtgaatttaaattcactctctaccggaacgatctgattctaatcaaggacaccctgaataactgtgagagaatgctcaggtttggatccaagaatgatacatctaaacactatgtcgagctgaagccccttgaaaaaggcactttcgacagcgaggaagagatattgccagtgctgggtaaggtggccaaatccgggcagttcatcaagggcttaaacaagcctaatatttcaatctacaaagtccgaaccgatgttctcggaaacaagtttttcattaaaaaggagggcgacaaacccaagctggattttaagaataacaacaaatga

SEQ ID NO: 2818 - RNA, 3390 nt, synthetic construct
  misc_feature 1..3390: note = Cas9 variant
  source 1..3390: mol_type = other RNA
atgagcaacggcaagatcctggggctcgacattggagtggcctccgtcggtgttggcataatcgatgctaaaaccgggaatgtgattcacgcaaactctagacttttctcagccgcgaatgctgagaacaatgccgaaaggcggggatttcgcggcgcacgacgtctgacaagaaggaagaaacatcgggtaaagcgcgtgagagacttgttcgagaaatacgatatcagtactgactttaggaacttaaatctgaacccctatgaactacgggtcaagggtctcacggagcagctgaccaatgaggaacttttcgccgctctgcgcacaattgcaaagcgaagagggatcagctacttggatgacgccgaggatgactccactggatcttcggattatgctaaatcaatagacgaaaacaggcggctcctgaagaccaaaacacctggccaaatccagctggagcgtctcgaaaagtacggccagttacgcgggaattttaccgtgtatgatgagaacggagaggcccacagactgattaatgttttcagcacaagtgactacaaaaacgaagcgaggaagatccttgagactcagtccaattataacaagcaaattaccgatgaatttatcgaggactacatagaaattttgacgcagaaacggaagtactatcatggtccaggcaacgagaaatctcgaactgactacgggcgcttcagaaccgatggaacaactctggagaatatctttggcattctaatcggtaagtgcagcttctatccggaagagtacagggcatccaaagcctcatataccgctcaggaatttaacttcctcaatgacctgaacaatcttaaggtgcccacagagaccgggaaactgagtacggaacagaaggagtacttggtcgattttgccaagaaaagcaaggcactcggagcttctaaactgttaaaggagatcgccaaaattgtggactgttccgtagatgacataaagggctatcgggttgataacaaggacaaacctgatctgcacactttcgaaccataccgcaagctcaaattcaatctttcaagcatcgacattgatgagctgagtagagaaacattggacaagctagcggacatcctgaccctcaacactgagagggaaggcatagaggatacaattaaacgtaatctgccctctcaatttaccgaggaacagatctccgagatcgtgcagattcggaagaaccagagctcggccttcaataaggggtggcattctttttccgcaaaacttatgaacgaactgatccctgagttgtacgtcacgtcagaggaacaaatgaccattctcacacgactggagaagttcaaagtgaataagaaaagtagcaagaacactaagaccatagacgaaaaagagatcacagatgaaatttataatccagtggtcgctaagtccgttagacagactatcaaaatcattaacgccgctgtgaagaaatacggagactttgataagatagtaatcgagatgcccagggacaaaaacgccgaggatgaaaagaagttcattgacaaaaaggagaaagaaaataagaaagagaaggatgactctttaaagcgcgcagcctttctgtataacggtaccgataatctacctgacggcgtgttccacgggaacaaagaactcaagacaaaaatccggctgtggtaccagcaaggagagagatgcctttatagcggcaagttgatttcaatccacgatctggtccataatagtaacaaatttgagatagaccacatcctcccactgtcccttagcttcgacgattctctggctaataaggtgttggtttacgcgtggaccaaccaggaaaagggtcagaaaactccgtatcaggtgattgactcaatggatgcagcctggagttttagggagatgaaggactacgtcctcaaacaaaaggggatcggcaaaaagaagcgcgaatacctgttaacgacagagaatattgataaaatcgaagtgaagaaaaagttcatagagcgaaacctggtagacacccggtatgctagccgtgttgtgctaaattccctccagactgccctgaaagagcttggaaaggataccaaagtctctgtggtcagaggccagtttacatcgcagttgaggcgcaagtggaagattgacaaaagccgggaaacctaccatcaccacgcagtggatgccctgatcattgctgcctccgggcaactcaagctgtggcagaaacatgagaacttaatgttcgaaaattatggagagaaccaggttgtgaataaggagactggtgaaatcctgtcaataagtgacgatgagtacaaagaacttgtattccagcccccttatcaaggctttgtcaacacaatctctagcaagacgttcgaggacgaaattttgttttcctaccaggtggattcaaagttcaacagaaaagttagcgacgcaaccatctattctactaggaaggcgaaactcgggaaggacaaaaaggaggagacatacgtgctgggaaagattaaagatatctacacccaggacggctttgatacattcataaagcgatataaaaaggacaaaactcagtttctaatgtaccaaaaggatccactgacctgggaaaatgtcattgaggtgatcctccgcgactatccctccgaaaagctgagtgaggatggtaaaaagacggtaaaatgtaaccctttcgaagagtaccggagagagaatgggcttatctgcaagtatagcaaaaagggcaacggaaccccaattaagtctttgaaatactatgacaagaaactgggcaattgtatcgatattacacccgaaaagtccaaaaacagggtggttttacgtcagatatcaccgtggcgcgctgacatctactttaatctcgagactctgaagtacgaacttatggggctgaaatatagtgatttgagcttcgagaagggaaccggtaagtaccacatttcgcaggaaaaatatgacgccatccgggagaaggagggcattgggaaaaagtccgaatttaaattcacactctacagaaacgacctgatcctaataaaggatactctgaataactgcgagaggatgctccgatttggatctaagaatgacaccagcaaacattatgtcgaactgaagcctcttgagaaaggcacgttcgattcagaggaagagatcttgcccgtgctgggtaaggtggcaaaaagtgggcaattcattaagggcttaaacaagccaaatatctccatttacaaagtccggacagacgttctcggaaacaagtttttcatcaaaaaggaaggcgataaacctaagctggactttaagaataacaacaaatga

SEQ ID NO: 2819 - RNA, 3393 nt, synthetic construct
  misc_feature 1..3393: note = Cas9 variant
  source 1..3393: mol_type = other RNA
atgaacaagatcctgggcctcgaccttgggaccaatagcattggatgggccctgatagagaacaatatcattttgggtatgggctccagagtgttccccgaaggggtcgttaacttaggagagggcgaaggtagggagacatctaaaaatgcttcacggactgaagcacgcggggtgcgacgtcagatctttagaaggcggctgcgcaagagatacctactcaaagagctggccaagcacaacctttgccctattagtccaacgctgatcaaagattggaatggaaccgacatattcaagaacgagttgatcattcaatggtttcagctcaatccgtatgaactgagggcgaaggctatccaggaggaaattacactgatcgagctcggccggatattctaccatatgattcagcgccgaggctttttaagcaactccagatctgccggggcagatgtaaaagagacttcgaccatcttcaagggagacgccaaaattggtaagatcggcatctcagatacactgaaaagcattgaacaaaataagacccttgggagttttctacactccatacagcccaaggagaacgaacctttctctggagagctggaaaggatccggaatcgttatactacacgccagatgtacattgacgagtttgagaccatctgggagttccagaaacaatatcatagcgaactaaactccaatctcaagacgatactgggcggtagaaagaaggataactacaaagaagacggggtgctttttcaccagaggccactgcggtcacagaagcatttggtcggattctgtagttttgagcccaaaaagactaagtgcaaactcagcgctattcctttcgaactgttccgaatctatcagtgggtgaacaccttatcttacgatgttaatggcgtgcgccaaaagatcacacaggaggagaggaaaaagattatcgacctgctcctttccaaagaaaagccatcatttaaggagattagaaaagcaataggcaagctggatgggagctaccagttcaactataaagacgatgacaagatcgtcggaagtcacactatttctaatttgtccaacaaaaagtttttcggtaataagtggtttgacttcagcgaaaaagagcaagaaaacatctggcacatcctatcgtttttcgatgaccgggagaagctgaaagagtacgccattaagaattggtcttttgatgaggaacgcgctgtgaaaatatccaagttcaacctcaaggacggctattcaaatctgagtagaaaagccatccttaacattctgccctttttgcagaaggggttcatgtacgatgtagcggttggactcgcaggcgtgaaaaataccctgagcgtcaactgggaggaacatgagcagtttgtgttagacaatgtgcctgaaatcgtcaggtccaacctgaagggtgggtatattgagccattgaaaaatatgctcaagaacgagttcaactgtaatgataaacagctggaaaaactttaccaccattctagcgccatcgaaacagagaacatattggaccgtctgccggttaatctccacgctgatcgggagatccaaaagattaaaaaccccgtggtaatcaccgccctgttcgaaattcgaaaacttgtgaatgaggtcatcgacacgtatggcaaacctaacgaaataaaggtggagctggcaagagatttgaaggcttcaaagagtaataggctcgaagcccgcaagcggcagaaagacctggagaagcagaacgacagagttaaattagagctggaaaatctaaaccagaggtccaatcacattaacatcctcaagtacaaactgtgggaggaatgcaatcatacttgtccatttacaggacaaattatcaccataagccagcttttcactggcgaggtgcagatcgaacacatttttccctggtctcgctcattgaacgatagtttcaataacaagacactgtgctttgcggacgagaaccgagccaaggggaataaaaccccttacgagctctatagcgaacagggagatcaaaagtgggaggcaatcaaactgcaggctttatcctgtttcaagacgaaagccaactacccaaattgctataacaagtttaagcatttcgtcaaaaagaaacacgacgaagattttatttctcggcagctgaatgacacccgttacatctcgaaggaggctaaaaactatcttagcaagatatgttccaatgtgttggtagcccccggtcagatgacagcaactctcagacatcactggggcctgaactcaattctaaatctggaggatgacaccaaaacaagggatgaccaccgccatcacgccatcgatgctctcgttatggcgtgcagtactcggtctcatctgcaagaacttagcaagagaaacaggtacaataagaactatgacttgaaagatttcccggacccttggcagaattttcgacaggacgcagagaacgccgtggctcaaatcctggtctcccacaagaaatcaaagagcttactcaccgtgcgcacacacaaaaccattaagaagggggtcgaacataaaaatatcggagtggccgcacggggccagctgcacaaggagtctgtttacggtcttagaaaagcccccaactccaacaaggctttccatattaggaaaccactggaaagtttgactacggagaagcagctcgagaagatagtggatgacagcatccgtctgctaattctgaaacgcatcaatattatcgggggctttataaagggaaaaatccctaaggaaacattcttcgtagtcgatgagaacggcattaaacagccccaaatctttctcccaaatcggaacgggaatcccgtgcctattaagaaggttagaatcagggaaaacataggaggtgccgagaaactgaaggaaaataccaaccagtacgtgaatccacgatctaaccaccatgtcattgtgtatgaggactccaatggcgggcttaaagatgacgtagtgactttctggaccgcagttgagcggaagcgccagggacaggatgtctttaaattgccgaacgacggcgaaaagatcgtgtcaacactgcaaatcaatgatatgttcttactcggtctgaacgacgatgacattataacccttacaagtaaggagctgaaaaagcacctatttaaagtgcagactctcagctcgtccttctacgaatttagactgtctacggatagcacccagaataagaacactaattcaacagtcttcaggcggatccagagttttgggatgggcaaaaccggatggaaggcgttcaaccccattaaagttaagttgaactccatcggcgaggtgaagattatctga

SEQ ID NO: 2820 - RNA, 3393 nt, synthetic construct
  misc_feature 1..3393: note = Cas9 variant
  source 1..3393: mol_type = other RNA
atgaccaacggcaagatcctggggctcgacattggaatagccagcgtgggtgtcggcatcattgaggctaaaacagggaaggttgtgcacgcaaattccagacttttctctgccgcgaacgctgaaaataacgccgagaggcggggatttcgcggctcacgacgtctgaatagaaggaaaaagcatcgggtaaaacgcgtgagagatttgttcgaaaagtacggtatcgtcactgactttaggaacttaaatctgaacccctatgagctacgggtgaaggggctcacggaacagctgaccaatgaggagcttttcgcagccctgcgcacaattagtaaacgaagaggaatcagctacttggatgacgctgaagatgactccactggctctaccgattatgcaaagtcgatagacgagaacaggcggctcctgaaaacaaagacccctggccaaatccagctggaacgtctcgagaaatacgggcagttacgcggaaattttactgtttatgatgagaacggtgaagcccacagactgattaatgtgttctcaacaagcgactacgagaaggaagctaggaagatccttgagacccaggccgattataacaaaaagattacggcggaatttatcgacgattacgtcgagatattgactcaaaaacggaagtactatcatggcccagggaatgagaaaagtcgaaccgactacggacgcttcagaacagacggcactaccctggaaaacatttttggtatcctaattgggaagtgctccttctatccggatgagtacagggcatctaaagccagctatacagctcaggaatacaactttctcaatgacctgaacaatcttaaggtgcccaccgagacgggaaagctgtccactgaacagaaagaggccttggtagagttcgcaaagtcaacagctaccctcggccctgccaaactgttaaaggaaatcgcgaaaatcctggattgtaaggttgacgagattaagggctatcgggaagatgacaaagggaagccagatctccacacttttgagccctaccgcaaacttaagttcaacctggacagtgtgaatatagatgacttgagcagagaagtcctagataaactggccgacatcctcacactgaacaccgagagggagggaattgaagacgcaatcaagcgtaatcttcctaaccagttcacggaggaacaaatatctgagattatcaatgtgcggaagtcccagtcaaccgcttttaacaaaggttggcatagcttcagtgccaagctgatgaatgagttgatcccagaactctacgctacatctgatgagcagatgactattctgacccgattagaaaaatttaaggtgaaaaagaagtccagcaaaaacatcaagacaattgacgagaaagaaataactgatgagatctataatcccgtcgttgccaagtcggtgagacagaccattaaaatcatcaacgcagccgtaaagaaatacggcgacttcgataagattgtgatagagatgcctagggacaagaatgctgatgacgaaaagaagtttatcgataaacgcaacaaggagaacaaaaaggaaaaggacgatgcgctgaaacgggcagcctatctatacaatgggacagacaagctcccagatgaggtcttccacggaaacaaacaactggaaaccaagattagactttggtatcagcagggcgagaggtgcttgtactctggtaaaccgatccccattcaagagctggtgcacaattccaacaattttgaaatcgaccatatactccctctgtcacttagtttcgacgatagcctggctaacaaggttttggtgtattcctggactaatcaggagaaggggcagcgcacgccataccaggtcatcgactctatggatgccgcatggagctttcgagaaatgaaagactacgtgctcaagcaaaaaggcctgggaaagaaaaagcgggattatttactgacaaccgagaacattgacaagatcgaagttaaaaagaaattcattgagcgtaatctagtagatactagatacgcctcaagggtggtcctcaacagtctgcagtccgcccttcgcgagttgggcaaggacaccaaagtgagcgtcgtgcgggggcagtttacatctcagctgagaaggaagtggaaaatcgataagtcacgagaaacctatcaccatcacgctgttgacgcactcataattgcggctagtagccaactgaagttatgggagaaacaggataatcccatgttcgtggactacggaaacaatcaggtagtcgataagcagactggtgaaatcctgtccgtgtctgacaacgagtataaagagcttgtttttcaacctccataccagggcttcgtgaatacaatttcgagcaaggggttcgaagacgagatcttgttttcctatcaggtcgattcaaaatacaaccgcaaggtgagtgacgccacgatatactctacccggaaggcaaaaatcggaaaggataaaaaggaagagacttatgtactcggcaaaattaaggacatctacagccagaacggtttcgatacatttgtgaagaaatataataaggacaaaacccaattcctgatgtaccagaaggatcccctaacatgggaaaacgttattgaggtcatcctgggggactatccgactaccaaaaagtccgaggatggcaagaatgacgtgaaatgtaacccttttgaagagtacagaagggaaaatggactcatatgcaagtatagcaaaaagggcaaagggacgcccattaagtcactgaagtactacgataaaaagctaggaaactgtatcgacatcaccccagaggaatctcgtaataaagtgattttgcagtccatcaacccttggcgcgccgacgtctatttcaatcccgagacactgaagtacgagttaatgggtctcaaatatagtgatctgagctttgaaaagggcactgggaactaccacatttctcaagagaaatatgacgctataaaggaaaaggagggaatcggcaaaaagtccgagttcaaatttaccctttaccggaatgatctgattttgatcaaggacattgcctcaggtgaacaggagatctatagattcctcagtaggacaatgccaaacgttaatcattacgtggaactgaaaccctacgataaggagaagtttgacaacgtgcaggaacttgtagaggcactgggggaggctgataaagtcggccgatgcataaagggactcaataaacctaacatcagcatttataaggtgcggactgacgttctgggcaacaaatacttcgtgaagaaggaaggggataaaccaaaacttgactttaaaaataacaagaaatga

SEQ ID NO: 2821 - RNA, 3393 nt, synthetic construct
  misc_feature 1..3393: note = Cas9 variant
  source 1..3393: mol_type = other RNA
atgaccaacggcaagatcctggggctcgacattggaatagccagcgtgggtgtcggcatcattgaggctaaaacagggaaggttgtgcacgcaaattccagacttttctctgccgcgaacgctgaaaataacgccgagaggcggggatttcgcggctcacgacgtctgaatagaaggaaaaagcatcgggtaaaacgcgtgagagatttgttcgaaaagtacgagatcgtcactgactttaggaacttaaatctgaacccctatgaactacgggtgaagggtctcacggagcagctgaccaatgaggaacttttcgcagccctgcgcacaattagtaaacgaagagggatcagctacttggatgacgctgaggatgactccactggatctaccgattatgcaaagtcgatagacgaaaacaggcggctcctgaaaacaaagacccctggccaaatccagctggagcgtctcgagaaatacggccagttacgcgggaattttactgtttatgatgaaaacggagaggcccacagactgattaatgtgttctcaacaagcgactacgaaaaggaggctaggaagatccttgaaacccaggccgattataacaaaaagattacggcggagtttatcgacgattacgtcgagatattgactcaaaaacggaagtactatcatggtccaggcaatgagaaaagtcgaaccgactacgggcgcttcagaacagacggaactaccctggaaaacatttttggcatcctaattggtaagtgctccttctatccggatgaatacagggcatctaaagccagctatacagctcaggagtacaactttctcaatgacctgaacaatcttaaggtgcccaccgaaacggggaagctgtccactgagcagaaagaggccttggtagagttcgcaaagtcaacagctaccctcggacctgccaaactgttaaaggaaatcgcgaaaatcctggattgtaaggttgacgaaattaagggctatcgggaggatgacaaaggcaagccagatctccacacttttgaaccctaccgcaaacttaagttcaacctggacagtgtgaatatagatgacttgagcagagaggtcctagataaactggccgacatcctcacactgaacaccgagagggaagggattgaggacgcaatccgtcataatcttcctaaccagttcacggaaggacaaatatctgagattatcaaggtgcggaagtcccagtcaaccgcttttaataaaggttggcacagcttcagtgccaagctgatgaacgagttgatcccagaactctacgctacatctgatgagcagatgactattctgacccgattagaaaaatttaaggtgaataaaaagtccagcaagaacacaaaaactatcgacgagaaggaagtcaccgatgagatttataatcccgttgtggccaaatcggtaagacagacaataaagatcattaacgcagccgtgaaaaagtacggcgacttcgataaaatcgtcatcgagatgcctagggacaagaatgctgatgacgaaaagaaatttattgataagcgcaacaaagagaacaagaaagaaaaggacgatgcgctgaagcgggcagcctatctatacaatgggaccgacaaactcccagatgaggtgttccacggaaacaagcaactggaaactaaaataagactttggtatcagcagggcgagaggtgcttgtactctggtaagccgatccccattcaagagctggttcataattccaacaattttgaaatcgaccacattctccctctgtcacttagtttcgacgatagcctggctaacaaagtgttggtctatgcctggacgaatcaggagaaggggcagaagacaccataccaggtgatcgactccatggatgcagcctggtcttttcgcgaaatgaaagactacgtactcaagcaaaaaggcctgggaaagaaaaagcgagattatttactgaccactgagaacatagacaagatcgaagttaaaaagaaattcattgagcggaatctagtggatacccgttacgctagcagagtcgtgctcaactcactgcagagtgcccttagggagttgggcaaggacacaaaaatctccgtcattcgcgggcagtttaccagccagctgcggagaaagtggaaaatcgataagtctagggaaacttatcatcaccacgcagtggacgcgctcataattgctgcctcaagtcaactgaagttatgggagaaacaggataatcccatgttcgttgactacggaaacaatcaggtggtagataagcagacaggtgaaatcctgagcgtctccgacgacgagtataaagagcttgtgtttcaacctccataccagggcttcgttaacatgatttcttcgaaggggttcgaagatgagatcttgtttagctatcaggtggactccaaatacaatcgaaaggtctcagatgcaacgatatacagtacccgcaaggccaaaatcggaaaggacaaaaaggaagagacttatgtgctcggcaaaattaaggatatctactctcagaacggtttcgacacatttattaagaaatataacaaggataaaacccaattcctgatgtaccagaaggaccccctaacatgggaaaatgtaatcgaggtgatactgcgggattatccgactaccaaaaagagcgaggacgggaagaacgatgttaaatgtaatccttttgaagagtacagaagggaaaacggcctcgtctgcaagtattccaaaaagggaaaaggcacgcccattaagtcactgaagtactacgacaaaaagttggggaattgtatcgacatcaccccagagggaagcaaaaacgaagtggtgcttcagtctctgaatccttggcgtgctgatgtctatttcaaccccgagacattaaagtacgagctcctgggtcttaaatattccgacctgagttttgaaaagggcactgggaaataccatattagccaagagaagtatgatgttatcaaggaaaaagagggaattggcaagaaatctgagttcaagtttaccttgtaccgcaatgacctcatactgatcaaagatacagcctccggtgaacaggagatttatcggttcctatcaagaactatgccaaacgtgaagcactacgcagaactgaagccctacgacaaagagaagtttgataatgtgcaggaactcgtagaggctctgggggaggccgacaaagtcggaaggtgcatcaagggccttaacaaaagtaatttgagcatttataaggtgcgaaccgatgttctgggcaacaagtacttcgtgaaaaaggaaggggacaaacctaagttagattttaaaaataacaagaagtga

SEQ ID NO: 2822 - RNA, 3393 nt, synthetic construct
  misc_feature 1..3393: note = Cas9 variant
  source 1..3393: mol_type = other RNA
atgaccaacggcaagatcctggggctcgacattggaatagccagcgtgggtgtcggcatcattgaggctaaaacagggaaggttgtgcacgcaaattccagacttttctctgccgcgaacgctgaaaataacgccgagaggcggggatttcgcggctcacgacgtctgaatagaaggaaaaagcatcgggtaaaacgcgtgagagatttgttcgaaaagtacggtatcgtcactgactttaggaacttaaatctgaacccctatgagctacgggtgaaggggctcacggaacagctgaccaatgaggagcttttcgcagccctgcgcacaattagtaaacgaagaggaatcagctacttggatgacgctgaagatgactccactggctctaccgattatgcaaagtcgatagacgagaacaggcggctcctgaaaacaaagacccctggccaaatccagctggaacgtctcgagaaatacgggcagttacgcggaaattttactgtttatgatgagaacggtgaagcccacagactgattaatgtgttctcaacaagcgactacgagaaggaagctaggaagatccttgagacccaggccgattataacaaaaagattacggcggaatttatcgacgattacgtcgagatattgactcaaaaacggaagtactatcatggcccagggaatgagaaaagtcgaaccgactacggacgcttcagaacagacggcactaccctggaaaacatttttggtatcctaattgggaagtgcaacttctatccggatgagtacagggcatccaaagcctcttatacagctcaggaatacaattttctcaacgacctgaataaccttaaggtgcccaccgagacgggaaagctgagcactgaacagaaagagtccttggtagagttcgccaagaatacagcaatcctcggccctgctaaactgttaaaggaaatcgccaaaattctggattgtaaggttgacgagataaagggctatcgggaagatgacaaagggaagccagatctccacacctttgagccctaccgcaaacttaagttcaacctggactcagtgaatatcgattacttgagtagagaagtcctagacaaactggcggatattctcactctgaacacagagagggagggaatcgaagacgccataaagcgtaatcttcctaaccagttcaccgaggaacaaattagcgagatcatcaatgtgcggaagtctcagtccacggcatttaacaaaggttggcattcattcagcgctaagctgatgaatgagttgattccagaactctatgccaccagtgacgagcagatgacaatcctgactcgattagaaaaatttaaggtgaaaaagaagtcttccaaaaacattaagaccatagatgagaaagaaatcacagacgagatttacaatcccgtcgttgctaagagcgtgagacagactatcaaaatcattaacgccgcagtaaagaaatatggcgatttcgacaagatagtgatcgagatgcctagggataagaacgccgacgatgaaaagaagtttattaataaacgcaacaaggagaataaaaaggaaaaggacgatgctctgaaacgggcggcatacctatataacgggaccgacaagctcccagatgaggtcttccacggaaataaacaactggaaacaaagatcagactttggtaccagcagggcgagaggtgcttgtattcgggtaaaccgattcccatccaagagctggtgcacaactctaataactttgaaatagaccatatcctccctctgtccctttcattcgatgacagtctggccaataaggttttggtgtacagctggaccaaccaggagaaggggcagaaaactccataccaggtcattgactccatggatgctgcctggtcttttcgcgaaatgaaggagtatgtgctcaaacaaaagggcctgggcaaaaagaagcgagactacttactgacgacagaaaatatcgataaaattgaggtaaagaaaaagttcatcgagcggaacctagttgacacccgttatgcaagcagagtggtcctcaattcactgcagagtgcccttagggaattgggcaaagatactaaggtgtccgtcgtgcgcgggcagtttaccagccagctgcggagaaaatggaagatagacaagtctagggagacataccaccatcacgctgttgatgccctcattatcgcagcgtcaagtcaactgaaattatgggaaaagcaggacaaccccatgttcgtggattatggaaataaccaggtagtcgacaaacagaccggtgagattctgagcgtgtccgataacgagtacaaggaacttgtttttcaacctccatatcagggcttcgtgaatactatctcttcgaaagggttcgaggacgaaatattgtttagctaccaggtcgattccaagtacaaccgaaaggtgtcagacgctacaatctatagtacgcgcaaagccaagattggaaaagacaagaaagaggaaacctacgtactcggcaagatcaaggatatttattctcagaatggtttcgacacttttgtgaaaaagtacaacaaagataagacacaattcctgatgtatcagaaagaccccctaacctgggagaatgttatcgaggtcatactgggggattacccgacaactaaaaagagcgaagacggcaaaaacgatgtgaagtgtaatccttttgaggaatatcggagagagaacggactcatttgcaaatactccaagaaaggcaaggggacccccatcaagtcactgaaatactatgacaagaaacttggaaattgtatcgatattacgccagaagagagcaggaacaaggtgatcttgcagtctattaatccttggcgtgcagacgtctacttcaaccccgagaccctgaaatatgaattaatgggtctcaagtactccgatctgagttttgagaaaggcacagggaattatcacataagccaagaaaagtacgacgccatcaaggagaaagaaggaattggcaagaaatctgagttcaagtttactctttatcgcaacgacctgatcttgattaaagatatcgcttccggtgagcaggaaatataccggttcctctcaagaaccatgccaaatgttaaccattacgtggagctgaagccctatgacaaggaaaaatttgataacgtgcaggagctagtagaggccctgggggaagcagacaaggtcggaaggtgcatcaaaagtctcaataagcctaacattagcatctacaaagtgcgaacagatgttctgggaaataagtatttcgtgaagaaagagggcgacaagccaaaacttgattttaagaacaataaaaagtga

SEQ ID NO: 2823 - RNA, 3393 nt, synthetic construct
  misc_feature 1..3393: note = Cas9 variant
  source 1..3393: mol_type = other RNA
atgagcaacggcaagatcctggggctcgacattggagtggcctccgtcggtgttggcataatcgatgctaaaaccgggaaggtgattcacgcatcttcaagacttttcagtgccgcgaatgctgagaacaatgccgaaaggcggggatttcgcggcgcacgacgtctgacaagaaggaaaaagcatcggatcaaacgcgtaagagacttgttcgagaagtacgaaattgtgactgattttagcaacttaaatctgaacccctatgagctaagggtcaagggtctcacggaacagctgaccaatgaggagcttttcgccgctctgcggacaatcgcaaaacgccgagggatatcctacttggacgatgccgaagacgattctactggatcgtcagactatgctaagagcatcgaggaaaacagaaggctcctgaaaaatatgacccctggccaaattcagctggagcggctcgagaagtacggccagttacgtgggaactttacagtgtatgatgaaaatggagaggcccaccgcctgatcaacgttttcagtacctccgactacaaaaatgaagcgagaaagattcttgagactcagtctaactataataagcaaatcacagatgaatttatagaggactacattgagatcttgacccagaaaaggaagtactatcatggtccaggcaacgaaaagagccggacggattacgggcgatatcgcactgacggaaccacactggagaacattttcggcatcctaatcggtaagtgcactttttacccggacgaatatagaacctccaaagcatcatacacagcccaggagtataatttcctcaacgatctgaataaccttaaggtgcccaccgaaacggggaaactgagtactgagcagaagcactacttggtcgactttgctaagagctctaaagccctcggagtggcaaagctgttaaaagagattgctaagatagtagaatgttccgttgatgacatcaaaggctacagggaggataataagggcaagcctgacctgcatacattcgaaccatatcggaaactcaagtttaacctttcactgattgatatcgacgagttgagccgcgaaaccctagataaactggccgacatactcactctgaatacagagagagaggggattgaagatgcgatcaagaggaaccttcccaatcaattcaccgaggaacagatcgtggagctggtcaacgtgcgtaaaaatcagagttctgccttcaacaagggatggcactcctttagcgtgaagttgatgaatgagctcattcctgaactgtacgcatcgtctgaggaacagatgacgatcttaacccggctggagaaattcaaggtcaacaaaaagtcctcagaaaatacaaaaactattaacgagaaggagataaccgacgaaatctataacccagttgtggctaagagtgtaagccaaacagtgaaaattatcaatgccgctgtcaagaaatacggtgactttgataagatcgtgattgagatgccccgagacaaaaacgccgatgacgaaaagaaattcatagataagaagcagaaagagaatgcaaaggaagttgaggacgccctaaaaagagctgcgtatctctacaacggcactgataagctgcctgacggggtgtttcacggaaataaacagcttaagaccaagatcaggttgtggtatcaacagggcgagcgctgcctgtactccggtaaaccaatttctatccaggatctcgtccataacagcaataacttcgaaattgaccacatcctgccgctttcactgagttttgatgactccttggcaaataaggtgctcgtatacgcctggacaaaccaggagaaagggcaaaagaccccctatcaggttatagatagcatggacgctgcctggtctttccgggaaatgaaagactacgtgctgaatcagaagggcatcggaaagaaaaagagagagtatttactgactacggaaaacattgataaaatcgaggtcaagaaaaagtttattgagaggaatctagtggacacacgctacgcatcacgagtcgtgctcaacagtatccaggccgctctgaaggaacttgataaagacaccaaggttagcgtgatacggggccaattcacttcccagttgcgtagaaaatggaagattgataaatctagggagacctatcatcaccacgccgtagacgcactgatcattgcggcttcgagccagctcaagctgtggcagaaacaagaaaatcctatgtttgtcgattacggggagaaccaggtggttaacaaggagacaggagaaatcttatccgtgtcagacgatgactataaggagctggtcttccagccaccctaccagggttttgtgaataccataagttctaaagccttcgaagatgagatccttttcagctaccaagtagactccaagtataaccgcaaagtgtcagatgcaactatttacagcacacggaaggccaaattgggcaaggacaagaaagaagagacgtatgttctcgggaagatcaaagacatttactctcaggatggatttgacgctttcatcaagagatataaaaaggataagacccagtttctgatgtaccaaaaagaccctgtcacttgggagaatgtgatagaagtgattctaagggattatccatccgagaagctgagtgaagacggcaaaaagaacgtcaaatgtaatcccttcgaggaataccgacgcgagaacggtctcatctgcaagtacagcaagaaagggaagggcacaccgatcaaatctctgaagtattacgataaaaagttgggaaattgtattgacatcacccctaagggctccaaaaacgaggttgtgcttcagtcactgaatccctggcgggccgatttatattttaacccagacacactcaagtacgaactgatggggcttaaatatagtgatctgagcttcgagaagggaactggtaaataccatatttcgcaggaaagatatgacgagataaaggtgaaagaaggcatcgggaaaaattccgagtttaagttcaccttgtacaggaacgacctcattctgatcaaagatacggagtctggagaagaggaactataccgttttctgagccgcaccatgcctaatgtaaagcactatgtcgagctcaaaccctacgacaaggagcggtatgatggcggtcaggaactgatgaaagtgttcgggaacgttgcaaatggcggacaatgccttaagtcattgaacaagagtaacctgtccatttacaaagtgagaacagacgtcttaggcaataagtttttcatcaaaaaggagggggataaaccaaagctcgactttaagaacaataaaaagtga

SEQ ID NO: 2824 - RNA, 3393 nt, synthetic construct
  misc_feature 1..3393: note = Cas9 variant
  source 1..3393: mol_type = other RNA
atgaccaacggcaagatcctggggctcgacattggaatagccagcgtgggtgtcggcatcattgaggctaaaacagggaaggttgtgcacgcaaattccagacttttctctgccgcgaacgctgaaaataacgccgagaggcggggatttcgcggctcacgacgtctgaatagaaggaaaaagcatcgggtaaaacgcgtgagagatttgttcgaaaagtacggtatcgtcactgactttaggaacttaaatctgaacccctatgagctacgggtgaaggggctcacggaacagctgaaaaatgaggagcttttcgcagccctgcgcaccattagtaagcgaagaggaatcagctacttggatgacgctgaagatgactccacaggctctactgattatgcaaaatcgatagacgagaacaggcggctcctgaagaataaaacccctggccaaatccagctggaacgtctcgagaagtacgggcagttacgcggaaactttacagtttatgatgagaatggtgaagcccacagactgattaacgtgttctcaaccagcgactacgagaaggaagctaggaaaatccttgagactcaggccgattataataagaaaattacagcggaatttatcgacgattacgtcgagatattgacccaaaagcggaaatactatcatggcccagggaacgagaagagtcgaacggactacggacgcttcagaactgacggcaccacactggaaaacatttttggtatcctaattgggaaatgcaatttctatccggatgagtacagggcatccaaggcctcttatactgctcaggaatacaactttctcaatgacctgaacaatcttaaggtgagcaccgagacaggaaaactgtccaccgaacagaaggagtcattggtagagttcgccaaaaacacggcaactctcggccccgctaagctgttaaaagaaatcgccaagatcctggattgtaaggttgacgagattaaaggctatcgggaagatgacaaggggaaacctgatctccacacatttgagccataccgcaaacttaaattcaatctggaaagtataaacatcgacgatttgagcagagaggtgattgacaagctagcggatatcctgaccctcaatactgagagggaaggaatagaggacgccattaagcgtaacctgcccaatcagttcacagaggaacaaatctctgagatcattaaagtccggaagtcccagtcaaccgcatttaacaaaggttggcatagcttcagtgctaaacttatgaatgaactgatccctgagttgtacgccacgtctgacgaacagatgaccattctcacacgactggagaaatttaaggtgaacaagaaatccagcaagaatactaaaaccatagatgaaaaggaggtgacagacgagatctataacccagtcgttgctaaatcggtgagacagactattaagatcatcaacgccgcagtaaagaagtacggcgatttcgacaagattgtgatagaaatgcccagggataaaaatgccgacgatgagaagaaatttatcgacaagcgcaacaaagaaaataagaaggagaaagatgacgctttaaagcgggcggcatatctgtacaactcttccgataaactacctgacgaagtcttccacgggaataagcaactcgagaccaaaattagactgtggtatcagcagggagagaggtgcctttactcaggcaagccaatcagtattcaagaattggtgcacaacagcaataactttgagatcgatcatatactgccgctctccctgtctttcgacgacagccttgccaataaggttctggtgtatgcttggacaaaccaggaaaaaggtcagaagaccccctaccaggtcatcgattcaatggacgccgcatggagttttcgcgagatgaaagattacgtgttgaagcaaaaagggctcggcaagaagaaacgagactatctgttaactacggaaaatattgataagatcgaggtaaagaagaaattcattgagcggaacctggttgacacacgttacgcctccagagtggtcctaaatagcctccagtctgctctgagggaacttggaaaggataccaaagtgtcagtcgtgcgcggccagtttacaagtcagttgcggagaaagtggaagatcgacaaaagcagggagacctatcaccatcacgccgttgatgcactgataattgcggcttcctctcaactcaagctgtgggaaaaacaggacaaccctatgttcgtggattacgggaagaatcaggtagtcgacaaacagacaggagagatcttatcggtgagcgatgacgagtataaggaactggtttttcaaccaccctaccagggtttcgtgaacaccatttcctcaaagggcttcgaggacgaaatcctttttagttatcaggtcgattctaaatacaaccgaaaggtgagcgacgccactatatactccacacgcaaagcaaagatcgggaaagataagaaggaggaaacgtatgtattgggaaaaattaaggacatctactcacagaatggcttcgatacctttattaaaaagtataacaaagacaagactcaattcctcatgtaccagaaggatagcctgacatgggagaatgtgatcgaggttatactacgggactatcctaccactaaaaagtctgaagatggtaaaaacgacgtcaagtgtaatccatttgaggaatacagaagggagaacgggctgatttgcaaatattccaagaagggcaaaggaactcccatcaagagtctcaaatactacgataagaaactgggcaattgtatcgacattaccccggaagagagccgtaacaaggtgatccttcagtctattaatccttggcgcgccgacgtgtatttcaaccccgagacgttgaaatacgaactgatggggttaaagtattccgatctctcatttgagaagggaaccggtaattaccacataagtcaagaaaaatatgacgctatcaaggagaaagaaggcattgggaagaaaagcgagttcaagtttacactgtaccggaacgatcttatcctgattaaggacatcgcctcgggagagcaggaaatatatagattcttgtccaggactatgccaaatgtcaaccattacgttgagctcaaaccttacgataaggaaaaatttgacaatgtgcaggagctggtggaggcactaggcgaagctgataaggtaggtcgatgcatcaaagggctgaacaagcccaacatttctatctataaggtccggaccgacgtgctcggcaataaatacttcgttaagaaaaagggagataaaccaaagctggactttaagaacaataaaaagtga

SEQ ID NO: 2825 - RNA, 3393 nt, synthetic construct
  misc_feature 1..3393: note = Cas9 variant
  source 1..3393: mol_type = other RNA
atgaccaacggcaagatcctggggctcgacattggaatagccagcgtgggtgtcggcatcattgaggctaaaacagggaaggttgtgcacgcaaattccagacttttctctgccgcgaacgctgaaaataacgccgagaggcggggatttcgcggctcacgacgtctgaatagaaggaaaaagcatcgggtaaaacgcgtgagagatttgttcgaaaagtacggtatcgtcactgactttaggaacttaaatctgaacccctatgagctacgggtgaaggggctcacggaacagctgaccaatgaggagcttttcgcagccctgcgcacaattagtaaacgaagaggaatcagctacttggatgacgctgaagatgactccactggctctaccgattatgcaaagtcgatagacgagaacaggcggctcctgaaaacaaagacccctggccaaatccagctggaacgtctcgagaaatacgggcagttacgcggaaattttactgtttatgatgagaacggtgaagcccacagactgattaatgtgttctcaacaagcgactacgagaaggaagctaggaagatccttgagacccaggccgattataacaaaaagattacggcggaatttatcgacgattacgtcgagatattgactcaaaaacggaagtactatcatggcccagggaatgagaaaagtcgaaccgactacggacgcttcagaacagacggcactaccctggaaaacatttttggtatcctaattgggaagtgctccttctatccggatgagtacagggcatctaaagccagctatacagctcaggaatacaactttctcaatgacctgaacaatcttaaggtgcccaccgagacgggaaagctgtccactgaacagaaagaggccttggtagagttcgcaaagtcaacagctaccctcggccctgccaaactgttaaaggaaatcgcgaaaatcctggattgtaaggttgacgagattaagggctatcgggaagatgacaaagggaagccagatctccacacttttgagccctaccgcaaacttaagttcaacctggacagtgtgaatatagattacttgagcagagaagtcctagacaaactggccggaatcctcacactgaacaccgagagggagggtattgaagatgcaatcaagcgtaatcttcctaaccagttcacggaggaacaaatatctgagattatcaatgtgcggaagtcccagtcaaccgcttttaacaaaggctggcatagcttcagtgccaagctgatgaatgagttgatcccagaactctatgctacatctgacgagcagatgactattctgacccgattagaaaaatttaaggtgaaaaagaagtccagcaaaaacatcaagacaattgacgagaaagaaataactgatgagatctacaatcccgtcgttgccaagtcggtgagacagaccattaaaatcatcaacgcagccgtaaagaaatatggggacttcgataagattgtgatagagatgcctagggacaagaatgctgatgacgagaaaaagtttatcaacaaacgcaacaaggaaaataaaaaggaaaaggatgacgcgctgaaacgggcagcctacctatataacggaacagataagctcccagacgaggtcttccacggcaataaacaactggaaaccaagattagactttggtaccagcagggtgagaggtgcttgtattctgggaaaccgatccccattcaagagctggtgcacaactccaataactttgaaatcgatcatatactccctctgtcacttagtttcgacgatagcctggctaataaggttttggtgtactcctggactaaccaggagaagggccagaaaacgccataccaggtcatcgactctatggacgccgcatggagctttcgcgaaatgaaggagtatgtgctcaaacaaaagggactgggcaaaaagaagcgagattacttactgacaaccgaaaatattgacaaaatcgaggtaaagaaaaagttcattgagcggaacctagttgatactcgttatgcctcaagagtggtcctcaatagtctgcagtccgctcttagggaattggggaaagacaccaaggtgagcgtcgtgcgcggacagtttacatctcagctgcggagaaaatggaagatcgataagtcaagggagacctaccaccatcacgccgttgacgcactcataattgcggctagtagccaactgaaattatgggaaaagcaggataaccccatgttcgtggactatggtaataaccaggtagtcgataaacagactggcgagatcctgtccgtgtctgacaatgagtacaaggaacttgtttttcaacctccatatcaggggttcgtgaacacaatttcgagcaaaggattcgaggatgaaatcttgttttcctaccaggtcgactcaaagtacaaccgaaaggtgagtgatgccacgatatattctacccgcaaagcaaagatcggcaaagacaagaaagaggaaacttacgtactcggtaagattaaggacatctatagccagaatgggttcgatacatttgtgaaaaagtacaacaaagacaagacccaattcctgatgtatcagaaagatcccctaacatgggagaatgttattgaggtcatcctgggcgactacccgactaccaagaagtccgaagatggcaaaaacgacgtgaagtgtaatccttttgaggaatatcggagagagaacggactcatatgcaaatactcaaagaaagggaagggaacgcccattaagagcctgaaatactatgataagaaacttggtaattgtatcgacatcaccccagaagagtctaggaacaaggtgattttgcagtccatcaatccttggcgtgccgatgtctacttcaaccccgagacactgaaatatgaattaatgggcctcaagtacagtgacctgagctttgagaaagggactggaaattatcacatttctcaagaaaagtacgatgctataaaggagaaagaaggcatcggtaagaaatccgagttcaagtttaccctttatcgcaacgacctgattttgatcaaagacattgcctcaggggagcaggaaatctaccggttcctcagtagaacaatgccaaatgttaaccattacgtggagctgaagccctatgataaggaaaaatttgacaatgtgcaggagctagtagaggcactgggcgaagctgataaggtcggaaggtgcataaaaggcctcaacaagcctaacatcagcatttacaaagtgcgaactgacgttctggggaataagtatttcgtgaagaaagagggagataagccaaaacttgactttaagaacaataaaaagtga

SEQ ID NO: 2826 - RNA, 3396 nt, synthetic construct
  misc_feature 1..3396: note = Cas9 variant
  source 1..3396: mol_type = other RNA
atggcccagcacgtgttcggcctggacatcgggattgctagcgtcggatgggcaatactcggtgagcaaagaatcattgatcttggcgttaggtgctttgacaaggccgaaaccgcgaaagagggggatcccctgaacttgacacggcgccaggctcgattactgcgtagaaggctataccggcgcgcctggagactcactcagctgtccaggcttctgaagcggaaaggattgatcgcagacgccaaactcttcgctaaggcaccttcttatggcgattcagcctgggaactgcgccgacagggtctggacagactcttaacgccactggagtgggctagggtgatttaccatcaatgtaagcaccgggggtttcattggaccagtaaggccgaagaggcgaaagcagatagcgacgccgagggaggccgtgtaaagcagggccttgctcacacaaaagccttgatgcaggcaaagaattatcgctccgctgccgaaatggtgctggcggagttcccggatgcccagagaaacaaaagggggcaatacgacaaggcactatctcgggtcctcctgggagaagaacttgctctgttgtttgccactcagcgacgcctcggtaatccccatgcttcggatttctttgagaagctgatcttaggcgacggggatagaaaatcaggactgttctggcagcagaagcctgccctcagcggcgcagaccttctgaaaatgttgggtaagtgcacctttgaaaaaggggagtatagggccccaaaggctagtttctccgtggaacggcacgtttggctaacacgcctgaacaatctcagaatagtggtcgacggaaggtctcgtcccctgaacgaggcggaacggcaagcagcccttctgttgccttaccagaccgagactagcaaatataagacactcaagaatgcttttatcaaagccggcctgtggggcgatggggtgcgattcggaggtttagcatacccatcccaggcccaaattgacgctgagaagaccaaagatcccgaagaccagtttctggtaaagctacctgcctggcacgagctcagaaaagcattcaaggcggctggccatgaagccctgtggcagcagatctcaacgccagcacttgatggggacccgactttgctggatcaaattgccaccgttctcagtgtgtacaaggacggagctgaggtcgtgcagcagctgaggcagcttgccctgcccgaacctgcagctagcatcgccgtgttggagaaaatatctttcgataagttttcctcactcagcctgaaagcgttacgccggattgtcccactgatgcaaagtggcctaagatatgacgaggccgttgctcagatccccgaatacggtcaccattctcagaggattgagcctggggcagccaagcacctctatctgccacccttctacgaagctcagcgcaaatatgccggcaagggagatcacatcggctccatgcaatttcgagacgacgcagatatcccgcggaaccctgtggtacttcgtgcgttgaatcaggccagaaaggtggtcaacgctctgattagggagtacgggagccccatagccgtgaatatcgaaatggcacgcgacctctcgcggccactggatgagagaaacaaagttaagagggctcaggaggagttccgagaccgcaatgatcgggccagatctgagtttgaaagggacttcggatataaacctaaggcagccgcttttgagaaatggatgttataccgtgagcagctgggtcaatgtgcgtactcccagcagccccttgatattcaacgcgtgttggacgatcataactatgcccaggtcgaccacgcactcccatactcacggagttatgatgacagcaagaataacaaggtgctggtactaacacatgaaaaccagaataaaggcaacagaactgctttcgagtacctgacctcctttcccgatggggaagacggagagaggtggcgaacattcgttgcctgggtgcagggcaataaggcctatcggatggctaaacgcaacagactcctgaggaagaattacggtgtcgacgaatctaaagggtttatcgatcggaaccttaatgacacccgatatatatgcaagttctttaaaaactacgtggaggagcacttgcaactggcagccagagcggatggcgacacggctaggcgctgtgtcgtggttaatggacagttaactgccttcctccgtgcacggtggggcctgacaaaggtgagaggggatagcgacaggcatcacgcccttgatgctgcagtagtcgccgcgtgcacccacggaatggtgaaggctctggccgactactcacgccgaaaagaaattagtttcttgcaggagggttttcctgatccagaaactggcgagatcctcaacccggcagccttcgacagagctcggcagcattttcccgaaccttggacacacttcgcccatgagctgaaggcaaggctatttaccgatgacctggctgccctccgcgaggatatgcaacgtctggggtcctatacgaccgaagaccttggaagattgcggacactgttcgttagcagggcgccacagcgccgatctggcggtgccgtgcacaaagagactatctacgcacagcccgaatcattaaagcagcaagggggcgtcattgagaaaatcctcctgaccagtcttaagctgcaggactttgataagctactcaatcctgaaagcaacgaccacttcgtggagccacatagaaatgagcggctgtatgctgccattaggcagcgcttggaacaatttggaggcagagctgataaagcattcgggcccgacaacctgtttcacaagccggataaaaataaccagcctacaggaccagtagtgaggtccataaagttagttcggggcaaacagactggtatccccattcgtgggggactcgccaagaacgactctatgctgcgcgtcgatatcttcaccaaggccggcaaatttcatcttgtgcctgtgtacgtccaccatcgagttacaggtctgcccaatagagctatcgtggcgttcaaggacgaggatgaatggaccttgattgacgagtcgttcgcatttctcttcagcgtgtatccaaacgattacgtaaaagtcactctgaagaaagagcagcaatccggctattactcaggggccgacaggagtacgggagctatgaatctatgggcccacgaccgggcagcctctgtgggcaaggatgggctgatacgcggaatcggcgttaagacagctcttagcgtggaaaaatttaacgtcgacgtgctcggtagaatttacctggcgcctcccgagaccaggtccgggttggcctga

SEQ ID NO: 2827 - RNA, 3399 nt, synthetic construct
  misc_feature 1..3399: note = Cas9 variant
  source 1..3399: mol_type = other RNA
atggcccagtacgtgttcggcctggacatcgggattgctagcgtcggatgggcagttctcgatgcccaaagaatagtggaccttggtgtaaggtgctttgataaggcggagaccgctaaagaaggcgaccccctgaacttgacacggcgccaggcccgattactgcgtagaaggctatatcggcgcgcatggagactcactcagctggccaggcttttcaagcgggaggggctgatcgatgacgctaaattgtttgcaaaggccccttcctggacggaaaatgcttgggagctccgcctgcgaggactggatcacctcttaaccccactggaatgggccagagtgatttaccatctttgtaaacacaggggcttccattggacatctaaggcggaggaggcaaaggccgaatcagacgctgagggtgggcgggtcaaacagggattggcccacactaaggcactgatgcaagtgaaaaactatcgtagtaccgctgaaatggttctagccgagtttccgggcgcgcagcgcaataagagaggccagtacgataaagccctcagcagggtgctgcttggggaggaactggcactcctcttcgctacacagcggcgactgggaaacccccatgcctccgagcactttgaacaattaatcctgggtcacggcgaccgcaagtctgggttgttctggcagcagaagcctgctctttcgggagccgatctgttgaaaatgctaggcaagtgcacctttgagaaaactgaatatagagcaccaaaggcctcattcagcgctgagaggcatgtctggctgacacggctcaataacctgcgcattgtggtagacggtagagcgaggccccttaatgatgcagagcgtcaggccgctctgttgctcccttaccaaaccgaaacgtttaaatataagactctgaaagccgcattcgttaaggtggggttatggggagacggcgtccggtttggcgggctggcctacccaagtcaggctcaggccgaggcagaaaaggcgaaagaccccgaggatcaattcctagtgaagctccctgcttggcacgaactgcgaaaagccttcaaggcagccggacatgaggctctttggcagcagatctccatgccagccttggaggaagacccgaccctgctcgatcagatagcaacagtgctgtctgtctacaaagacggtactgaggttgtgcaacagcttagacagctggctttgcccgaacctgatgccagcatcgcggtactcgagaagattaggtttgacaagttctcctcactgagtttaaaagccctgcgccggatcgtgccactaatgcagggcgggctcagatatgatgaagctgtcgcacaaattcccgagtacggacaccacagccagaggatcgaccctggcgccacccgccatctgtatcttccacccttttacgaggctcagcgaaagtatgccggtaaaggggatcggataggctctatgcagttccgtgaagacgcagatgtgccgagaaaccctgttgtgttgagggcgctgaatcaagcccgcaaggtcgtgaacgctctcattcgggagtacggatcccccgtagccgttaatatcgaaatggcaagagacctgtcaaggccattagacgagcgaaacaaagtgaagcgcgctcaggaggaatttcgggatagaaatgacaaggccaggagcgagttcgaacgtgattttggctataaacctaagggggcagtcttcgagaaatggatgctgtaccgcgaacagcttggacagtgtgcctacagtcaacagcccttggacattcagcgggtgctcgatgacccaaactatgctcaagtcgatcacgcgctgccctactctagatcctatgacgatagcaagaataacaaagtgctagttctgacaagggagaaccagaataagggtaaccgaaccccttttgagtacctcacgtcgttcccaggcggggaagacggagagcggtggcgcgcctttgtggcatgggtacagggcaataaggcttatagaatggccaaaaggaaccggctgcttcgaaagaattacggtactgatgaatctagagggttcatcgaccgcaacttgaatgatacaaggtatatctgcaaatttttcaagaactacgtcgaggaacatctgcagttagccgctcgtaccgacggcgacactgcacggagatgtgtggttgtgaatggacaactcacagccttcctgagggcgcgctggggccttgctaaagtccgaggggattccgacagacaccatgccctggatgcagccgtggtagctgcatgcacccacggaatggtgaaggccttggcggactactcacggaggaaagagattgcttttctccaggagggtttcccggatcccgaaacgggcgagatactgaacctagccgcatttgaccgcgcccgtgaacacttccctgagccatggccccattttgctcacgaactgaaggccagactcttcatcgatgacctggttgcacttcgggaggatatgcagcatttggggagttatgctcaggacgatctggacaggttacgcaccctctttgtcagccgagcccctcaaagacggaatggaggcgcggtgcacaagggtacaatttacgcccagccagagaacctgaaacagcaggggtccactatcgaaaagatacttctgaccggcctaaaactccaagatttcgacaagctgttgaatcccgagtctagcgaccactttgtggaaccgcataggaacgagcgcctgtatgcagctattagaaggcggttagaggagttcggaggcaaagccgataaggcttttgggcctgacaagccattctacaaacccgataagaatggacagcctacaggccccatcgtccgttcaatcaaactcgttcgcggtaagcagactgggattccaatccgaggaggcctggccaaaaacgacagtatgcttagagtggatgtgtttaccaaggcaggtaagttccacctggtacctgtctatgtgcatcacagggttacaggcttgcccgaccgggccattgtggctttcaaagatgaagaagagtggaccctcatagacgaatcctacgcgtttctgttcagcgtctatccaaacgattttgtgtgtgttcaacagcgcgggaagccgctaatcgagggatactacgcaggcctggacagagccaatgggaacattaatgtgtgggctcatgatagggccgcatctgtaggaaaagacggccttatccggggtatcggggtcaagactgccctctcactggagaaattgaacgtggacgtgctgggacgaatttatcctgctcccccagaaacgagacgcggcttagcgtga

SEQ ID NO: 2828 - RNA, 3399 nt, synthetic construct
  misc_feature 1..3399: note = Cas9 variant
  source 1..3399: mol_type = other RNA
atgaagaaaatcctgggcgtggacctcgggattaccagcttcggatacgccatacttcaggagacaggtaaggatctgtatagatgcttggacaactccgtcgttatgaggaataacccctacgatgaaaaatctggcgagtcaagtcaaagcatccggtccactcagaagtctatgcgccgattaattgaaaaacgtaagaagagaatcaggtgtgtggctcagacgatggagcggtatgggattctggactactcggaaaccatgaaaatcaatgatcctaagaacaatccaattaaaaaccgctggcagctaagagcagtagacgcctggaagaggccgctctcaccccaagagctgtttgcgatcttcgctcacatggccaaacatcggggatataagagcattgcaacagaggatcttatctacgaactggagttggaactcggcctgaatgaccctgagaaggagagtgaaaagaaggccgatgagcgccgacaggtgtataacgctctgagacacctcgaagagttaaggaaaaagtacggtggggaaactattgcacagaccatccatcgggccgtcgaggctggagacctgcgttcctaccgcaatcacgatgactatgagaaaatgataagaagggaagatattgaggaagagatcgaaaaggtgcttttgcggcaggccgagctgggcgcgctaggcctcccagaggaacaagtttctgagctgattgacgaacttaaagcatgcatcacagaccaggagatgcccaccatcgatgaaagcctgtttgggaagtgtactttctacaaggacgagttggccgctcctgcctattcctacctctatgatctgtaccgattatataaaaagctggcagacctcaacattgatggatacgaggtgacacaggaagaccgcgagaaagtcatagaatgggtggagaagaaaatcgctcagggtaagaatcttaagaaaattacccataaggatctgagaaaaatcttgggcctagccccagagcaaaagatatttggggtagaagacgagaggattgttaaaggaaagaaggaaccccggacgttcgtgccatttttctttctggcggatatcgccaaattcaaggagctctttgcatcaatccagaaacaccctgacgctctgcagattttccgcgaacttgccgagatcctgcaaagaagtaagactccgcaggaggctttggataggctccgtgccctgatggcaggcaaaggtattgacaccgacgatcgggaattactggagctatttaagaacaagcgaagcgggacaagagaactctctcacaggtacatactggaggcccttcccttgttcctggaaggatatgacgagaaagaggtccagcgcatcctcggcttcgatgaccgggaagattactccagatatcctaagtcactgaggcatcttcatctgcgcgagggcaatttgtttgaaaaagaggaaaacccaattaataaccacgctgtgaaaagcctcgcgagttgggcactggggttaatcgccgacctgtcttggcgatacggacccttcgatgagatcattctagagactacccgggacgctctccctgagaaaatacgtaaggaaatcgataaagccatgagagaaagggagaaggcactggacaagattatcggtaaatataagaaagagtttccatccattgataagcgccttgcccggaaaatccagttgtgggaaagacaaaagggcctggacctctacagcgggaaggtgataaacctgtcgcagttactggatggatctgctgacatcgagcacattgtcccccagtcccttggcggtttgtcaacagactataataccatcgttacgctcaaaagtgtgaacgccgcaaaggggaataggctgccgggcgattggctagcgggaaaccctgactaccgagaacgcattggcatgctgagcgagaaagggctcatcgattggaagaaacggaagaatctgcttgctcagtccttggacgaaatatacactgagaacacacactctaagggaattagagccaccagctatctggaggcattagtagcccaagtgctcaaaaggtactatcccttcccagatcctgaactgcgtaagaatggtatcggcgtccgcatgattcccgggaaagtgacttcaaagacacggagtcttctgggaatcaaatccaagagcagagagaccaactttcatcacgctgaagacgccttgatactctctacgctgaccaggggctggcagaatcgactacatcggatgctgcgcgataactacggtaagtcagaggcagaactcaaagagctgtggaagaaatatatgccacacatcgaggggcttacattggctgactacattgatgaagccttcagaaggtttatgagtaagggcgaggaaagcctgttctatcgggacatgtttgatactatccgatccatttcttactgggttgacaaaaagcccttatcggcgagctcccataaagagaccgtgtactcaagtagacacgaagtccctacactccgcaagaatatcctggaggccttcgattctcttaacgtgataaaggacaggcacaaactgactaccgaggaatttatgaagcgttatgacaaagagattcggcagaagctatggctccatagaatcggaaatacaaacgatgaaagctacagggctgtagaggagcgcgcaacccagatcgcccaaattctgactcgatatcagttgatggacgctcagaatgataaagaaatcgacgagaagttccagcaagccctgaaggaattaattacgtccccaatagaggttacaggcaaactcctgagaaagatgcggtttgtgtacgataaacttaacgcaatgcagatcgacagggggctggtcgaaaccgataagaacatgttgggaatacacatctcaaaaggtccgaatgagaagctcattttccgccgtatggacgtgaacaatgcgcatgagctgcagaaggaaagaagcggcatcctatgctatctgaacgagatgcttttcatatttaataaaaaggggctcatccactacggatgtctgcggtcttatttggaaaaaggccaaggttccaagtacattgccctgttcaaccccaggtttcctgctaatccaaaagcccagcccagtaagttcactagcgattctaagatcaaacaggtcgggattggctccgcaaccggaatcataaaggctcacttagacctcgatggccatgtgcgctcatacgaggtttttgggacactgcctgaaggaagtattgagtggttcaaagaggaaagcggctatggtcgagtggaggacgacccacaccattga

SEQ ID NO: 2829 - RNA, 3402 nt, synthetic construct
  misc_feature 1..3402: note = Cas9 variant
  source 1..3402: mol_type = other RNA
atggacctgaactacagaatcggcctcgatattgggatagccagcgtgggatgggctgtccttgagaataactccaaggacgaacccgttaggatcgtggatctgggtgtacggttgttcgaggcagccgaagtgcctaaaaccggcgcggctttagccgagccacgccgagaagcacgtacaactagaaggcggctgcgcagaaggaagcaccggctagagcgcatgaaatggctcctgcaggagtatgggcttattcaaacggaagagtttatgaagcgataccattctgccggactgccggacgtctatagattgaggtacgaaggcctcgagcggaaactgaaggatgaggaactggctcagatcctcattcacatcggtaagcatcgtgggttccgctcaaccagaaaagcagagttaaaggacaaaaatgataaggaaacaggagccgtgctgagtgctactagggagaacgaaaaacttatggaggagcacggctatcggaccgccggcgaaatgatatacaaggacgataagtttcgaacagggtgcacctggaaagaggaaggatatcgcttgactcccagaaataaggagggtgactacaaaaacacaatgctgagggcgctactcgaagatgaggttaaggtgatcttcgactgtcagcggaaatttggcaatcagaaggcaagcgaggaactggagaaagcctaccttgctattatgacctcccaacgctctttcgatatggggcctggaaagcagccagacggctcggcctcaccctatgcaatggaaggttttggggacagagtcggactgtgcgctttggagcctagggaaaagcaggagccacgtgcccccaaagcggcctacacgagcgaactcttcgtggcactgcagaagatcaaccatttacggattactgaaaagaatggcaagggccgagggctgaccagtgaggaaagagagaggctctccgatcttctgcacaaaaagaaggagttgacatatggagctgtacgcaaagaactacaactggacctccggtacagatttaacactctgaattattctagcaagaaaatgaccgaggaagagaagatcaaagatgccgaaaaggctaagttcgtttccatggtgtcacactacgagtataggaaacgcatgagtggtatgcttgagcagctgagccctgaggagcaggccgacttgatggatgaagtcggcaagatactcacactgtacaaaaacgacgatacccgatctcgggagtttcagaagttagggctggactccgaaattacggaggagctactcgaactgaatccacgtggattccaacatgtgtcacttaaagcaatgaagaagttgatgccgtacctgaaagagggcctcacttatgataaggcctgtgctgaagcgggttacgactttcaggggagcgtgcagaaagagagaagtaggctgcttaagggcaaagaaatcacagatattatcaacgacatcaataaccccgtcgttaagcgctctgtgtcccaaaccgtaaaagtgattaacgcaataatccagaagtatggaagccctcaggccgtcaatattgagctggctcgggagatgtcgagaaactacgacgaaaggcgaaagatggagaaacagatgaaggatcgccaatctgaaaatgagcgggccaaaaaggagatccaggaattgggcaacgcattcccaactgggcaggacatactcaaatatagactgtggcacgatcaggacggaatttgcatgtactccgccaagaggatccccttagctgagctgttcacaggtgcctatgatatcgaccatattctaccttactcaatcacctttgatgacagttaccgtaataaggtgctcgttacgagcgaagagaaccgccaaaaaggcaatcggattccatatgaatacttcgggtccgattctgagagatggagcaagtttgagaccctggtgaactcaaggatacgagactatcggaaacagcagaatcttttgaagcagagtttcacagaagaggaacgcaaagagtttaagcaaagaaacctgaatgatactaagtacatcaccagggtcatttataacatgatccgggaaaatctcgcactggcgccctacaactccccgggcaaaaagaaacaggtgttcgctgtaaatggaggtgttacagcctatttacgaaagagatgggggatgagcgcaaaagaccgctctatcgatactcaccacgccagggacgctgtggtcattgcctgttgcaccgacggcatgatacagaagatctcacgtaacattcagggacgggagctgctttacgcaagaggctttacagctgtggatgtcgagaccggggaaaagttcactagggacgattttacgcgcgaccaatgggatgagatcttcggagtgcaggttcctaaaccctgggaatactttaacgaggaattggacattcgactcggtgagaatccagtggagttcatcgaaacacatagtgatgtaagcagaaagctggactatcctgcctggttttacgagaacaatataatccggcccgtcttcgtgtccaggatgccaaaccgcaaagttaccggcgcggcccacgctgatactattcgttctcccagacattatcaggaaaccgggtcggtgctaacaaagaccgcactgatcgacctcaaactgaataagaaaactggagagattgagaactactataagcctgaaagcgatacacttttgtacaatgccctgaaggagcggttagaactctatggcggtgacgggaaaaaggctttcgaggaaccattttacaaaccgaaggccgatggctccaggggaaacctggtccgcaaagtgaagacgtacgacaaacttaccctgggcgtatatgttaattcacaacacgggatcgcagcgaacgccaatggaagtatggtgcgagtcgacgtgttcagagtgtctggcaaatactattttgtccccgtttacatagctgatgtggtgcggaagaggttgcctatgaaagccgtagtccagggtaagcagtatattgactggaaagagatggaggataaggacttcatctttagcctctacactcgcgatctgatttccttcaagagcaaaaacgggaagaaagtgacatgtgttgacggaacctcaaaggcagtgaatgaagagatcgtctattactacggcgctaacatatctacagcctcctttagtggtaaaagccataatggctctttcgaatttacttccctagggatccagggactggagtatctcaagaagtaccaagtggatgttctgggcaacgtgtcagaagtaaaaagagagaagaggatggggttccggtga

SEQ ID NO: 2830 - RNA, 3402 nt, synthetic construct
  misc_feature 1..3402: note = Cas9 variant
  source 1..3402: mol_type = other RNA
atgggcgggttcgaggtggacagaaagatcagcctgggactcgatattggtgtctcctctgttggctactcagtgatagacgtagataccgggaaagtgcttgaactgggaagtaggttgatcaacggcaagattggtacagagaatcaggcccggcgcgaaatgcgagggactcgtagattaatcaacaggaaaaagcaacggcgcaaagacacggtcaagctgtttaatgagttcaagctaattgatagcaaaaaggacgaacactattttgatcatttcgctaacaattccgacccctacgagctcagagtgaaaggactgtctgagaaactttcgctgtcagaaatcgcagatggcttgtatcacatagttaagaggcggggcatcagctacgacctcaaggatgccgacgaggaaagtgaggggtccgagtatgaaaacggactgaagattaataactctgagctgaaaaatcagacccctgcgcagatccagctcaagcgcttaaacgaatacggtgctattcgaggcaaagtggtcatcgatgaggaaaagatactgcttaatgtgtttccaacaaaagcctatttggacgaggcaaagagaattatcgagaaacaaagggagttctacccggggattctgactgaggaatttgaggaaaagtactgccagatcctaacccggaagcgtgactatttcgtaggacccggcagcgagaaatcccgcacagattacggtatctataaggaggacgggagaaccctcaacaatctgtttgaagaacttattggacatgataaaatataccctgaggaactgagggcctcaggcgctagtttcactgcacagttgtttaacgttctcaatgacctgaacaacttacacatcagctcttatgaagatcagaagctgacaaccgagaataaagagcaaattatctccgaactcaagtcaacgactagcaacgtgaatatgatgaaacttatacagaagattgccggctgtgaggaaagtgacatctctgggtaccggaccgataagaactataaaccagagatctccagcatgcgaatttaccgcaaggtccataaaaagctgttggagtcggaaatcgacattacaaattggcccgatgacttcataaacaagctatcttttatcctgactctcaataccgagaacggagaaattagaaatcagctgaaaaacaggcttcagcctgagtacgatttcctgacagacgaattgatccaaaccatcattgacaataaggagtccttcgatataaaatcaaacaataagtggcaccggtttagtatcaaaacgatggagctcctgattccagaaatgatcaagcgccccgtggagcagatgactttaattaacgaaatgggtctgatcaagaatagcggcaaaaagttctccaactataaatacctaccttataagaaaatagctgaggacatctacaacccagtggcctctaagagcgtcagagaagcgctcaaaattgttaatgcaatcctgaaggagtatgggcacattgagtacatcgtggtagaaatgccgagggataagaacgaggacgaagccaaagatcagatagagaagtttcaaaaagctaatggacgtcttaaggacgccgcattggaagagttcacagaggctattggcgataaatcaaccgtggacaagaagctgggtgtccatcggagtaaactcctgtttaagatccgactttggtatcagcagagagggatggatctgtacgaaggcaaacccatttccgccgtggacttgctcaacaatcctgatagcttccagatcgaccacataatcccacaatctgtttcatttgatgacagtttcaacaataagactctgtgcaacagcggattaaatcagattaaagacaagaagacaccctttgagtacatgaacgaaggctatgggcagggattcgattccatgaaagcgatggtgatgaagaatcctaggatcgaccataacaaacgcaagaattacctgttttctgagaacgtctcggatattgagacccggaaaagattcatcagcaggaatctagtggacacgcgctatgcctcccgagtagttctcaacaacctgcaggaatttttcaaggagaaggaatcagataccaaaataagtattatccggggtaagttcacatctaatcttcgtaaacactggaagatcaacaaaaatagagacacttaccaccatcacgcaattgatgctaccatcattgccgctacaccatttttgaacatatggaagaaaggcagctccatcttcccctcaaatgtggagagcgaagactttttcgatattaagactgggaagatcattggaaacgacgagtttaataaatatgcctacgatgagccgtataacggcttctacaatgaactgaggaacgcaaccgaccgcatcaagttttctcatcaaatagataaaaagatgaatcggaaagtctccgacagtacaatctacagcaccagagtggccaagtctcctaagaacaaaaaggagtccgaatatattgtcgctaaaatcaagaatatttacgacgcggatgagtatgcaaaattcaagaggatctacgacaaggataaaactaagtttctcctgaacaaatatgacccccgatcattcaatcacttagaaaagataatgaacacgtacccagatagtattgagcgcacaatgagcaacaataaagtgaaggttgtgcggatctcgccttttgagctgtatagacaggaccatggtcccgtaaagaaatactccaagaaaaacaatgggccagaaatcaagcagcttaaatacttggataagaaggtcggctctagcattgacgtgacccccgataacgccaaaaataagcacgttatactcaaatcactgaagccttggaggactgacatctatctaaaccacgagaccggagaatacgagattatgggcatcaaatatagtgatctgaagttcaataaaggggaaggatacggtattaagaaggctaaatatctcgagatcaagcatcgtgagaaagtgtccgacgactctgaatttatgttcacactgtacaagaaaaaccgcataaaggtcgagaatatggaaaccgatgagagcgtggagatgcttttctggtcccggactatggactcacagaagggctatgccgaattgaaaccaatctacaagtacaaaacagaggatgacaactggccgatttatgggaatgcaaagaaacaaatcattaagaagctgatccccaaaaactgtaagatatggaaagtaaatacggatgtgttaggaaaccctttttacgttgaaaaggagggcgaatatccaaaagacgtcctcgattga

SEQ ID NO: 2831 - RNA, 3405 nt, synthetic construct
  misc_feature 1..3405: note = Cas9 variant
  source 1..3405: mol_type = other RNA
atgaacggcctggtgctcgggcttgacatcggaattgccagcgtcggtgttggcatactggagaaaaattccgggaaaatcgtgcacgcttcttcaagaattttccccgcagccaccgcggataacaatgtagaaaggcggaagaaccgccaggctcgacgtttgcatagaaggaaaaagcaccggggagcccgcttaaaagacctgtttgagtactatggcctactcacagatttcagtaaggtgagcatcaatctgaacccttacagacttagggtcgacggtctggatcaacagttgactaatgaagaactctttattgcactgaagaacatcgtgaaacggcgcgggatatcctatctggacgatgcctctgaagacggaggcacggtttcgtcagattacggcaaggctgtggaggagaatcgaaaactcttagcagaacagaccccagggcagatccaactggagagattcgaaaagtatggacagcttaggggtgactttacagtcgtggagaacagcgagaaatgccggttgattaatgtattcagtacttccgcctacaagaaggaagctgagcgtatcctgcgcaaacagcaggaatttaacaatcaaattaccgatgagttcatcgaagactatctaaagatactcacaggcaaaagaaagtactaccatgggccgggaaacgagaaatctaggaccgattatggccggtttcgaactgacggtgccacactggacaatattttcgggatccttattggaaagtgtaccttttaccccaacgagtatcgcgcgagcaaagcatcctacacggcccaggagttcaacctgttgaatgatctcaacaatctgactgttcctaccgagacaaagaagttatcagaagaacagaaaaagactatcatcgaatatgctaaaagtgccaagaccctgggcgcaagcacactccttaaatacattgctaagatgatagacgcctctgtggatcagatcagaggctatagggtcgacgtgaacaataagccagagatgcacacctttgaggtgtaccggaaaatgcaatccctggaaacgatttcagtcggggagttgagccgcaacatcctagatgaactggcgcatatactcactctgaatacagagagagaaggaattgaggaggccatcaacaccaagctaagggacagtttctctcaggatcaggttctggaattggtgcaattccgtaaaaataactccagcctcttttcgaagggttggcacaatttctctctgaaattaatgatggagctgatccccgaactatacgagacttccgaggaacagatgacaattctcacccggctgggcaagcagaagtcaaaagagacgagtaagcgaaccaaatatatcgacgaaaaggaggtaacagaagagatttacaaccctgtggtcgcaaaaagcgtgagacaggctataaagatcattaatgaggccactaagaaacacgggatctttgataacatcgttattgaaatggctagggagaataacgaagaggacgccaagaaagattatataaagcgccaaaaagcaaaccaggacgaaaagtacgccgctatggagaaagcggcattccagtataatggaaagaaggagcttccagacaacatctttcatggccacaaagaattggccaccaagattcggctgtggcatcagcaaggtgagaaatgcctctacacagggaagtccatccccatttctgatctgatccacaatcagtataaatacgaaatagaccacatccttcctctgagcttgtcattcgatgacagtctctccaacaaggtgctggtcttagctactgccaatcaggagaagggccagagaaccccatttcaagcactggatagcatggacgatgcctggtcttacagggagttcaaatcatatgtgaaggagagtaaactactcggaaacaagaaaaaggagtacctgcttacagaagaggacattagcaagatcgaagtaaaacagaagtttattgagcgcaatttggttgatacccgatattcctctcgggtggtcctgaacgctctccaggacttctacaaaaatcataactttgatactacgatctcggtggtccgtggccagttcacaagccaactgagaaggaagtgggggttagagaaatcccgcgaaacctatcaccatcacgccgtggacgcactgataattgcggcttcaagtcagcttcggttgtggaagaagcagaataacccgctcatcgcctacaaagagggacaatttgttgattctcagactggtgaaattatcagcctgaccgacgacgagtataaggaacttgtgttcaaagcaccctacgatcatttcgtagacacactgtcctcaaagacctttgaggatagcatactcttctcttaccaggtcgactccaaatttaatagaaagatcagtgatgccactatttatgctacaaggaaagccaagctggacaaggagaaaaaggaatacacgtatacccttggcaaaatcaaggatatttacagcttggggactaaaacaccttctaagaccggattctataagtttctggacttatacaacaaagataagtcccagttcctcatgtttcaaaaagaccgaaagacatgggatgaggtgatcgaaaagataatggagcagtatcgcccattcaaggaatacgacaaggcaggcaaactggttgattttaatcccttcgagaagtaccggcaggagaacggtcctattagaaaatattcaaagaaagggaacggcccagaaatcaagagtcttaagtactatgacatcctgttgggaaaacacaagaatattactcccgagggcagcaggaacaccgtggctctcctgtcgctaaatccgtggcgtacggacgtctactataacatggaaaccaaaaagtacgagtttctggggctcaaatatgccgatctgcctttcgaagagggaggtgcgtacggcatctccacagagacttacaatgaacttcgcgagaaggaagggattggaaagaactctgagtttaaattcaccttgtataagaatgacctgatattaatcaaagatacagagactaactgtcagcaattctttcggttctggagcagaaccggcaaggacaatcccaaatcatttgaaaagcacaaaattgagctcaagccatacgaaaaggccaaattcgagaagggtgaggaactggaggtgcttgggaaagtacctcccagttccaaccagtttcagaagaatatgcagatcgaaaacctgtctatttataaagtgaagacggatgttctaggcaataagcatttcatcaaaaaggagggagacaaaccaaagctcaaattttga

SEQ ID NO: 2832 - RNA, 3405 nt, synthetic construct
  misc_feature 1..3405: note = Cas9 variant
  source 1..3405: mol_type = other RNA
atgaacggcctggtgctcgggcttgacatcggaattgccagcgtcggtgttggcatactggagaaaaattccgggaaaatcattcacgctaactctagattgttccccgcagccaccgcggataataacgtggaaaggcggaagaatcgccaggctcgacgtttaaacagaaggaaaaagcatcggggagtacgctttcaagacctgttcgaggattacggcctactcacagacttttcaaaagtgagtatcaatctgaacccttatagacttagggtcgatggtctgaatcagcagttgactaacgaagaactcttcattgccctgaagaatatcgtgaagcggcgcgggataagctacctggacgatgcatccgaagacggaggcgccgtttcttcggattatggcaaagctgtggaggagaaccgaaagctcttagcagaacagacgccagggcaaatccagctggagagatttgaaaaatacggacaggtcaggggtgacttcaccgtggtagagaatggcgagaaacttcggttgattaacgttttctcaacaagcgcctataaaaaggaagctgagcgtatcctgcgcaagcagcaagaatttaataaccagattactgatgagtttatcgaagactacctaaaaatactcaccgggaagagaaaatattaccacggaccgggcaacgagaagagtaggacagattacggtcggttccgaaccgacgggactacactggacaatatttttggaatccttattggcaaatgcaccttctatcccgaggaataccgcgcctccaaggcgtcttatacggcacaggagtttaacctgttgaatgatctcaacaatctgactgtgcctaccgaaacaaagaagttaagcgaggaacagaagaaagtcatcgtggagtacgccaaggaggctaaaactctgggcgcctccaccctccttaagtatatcgcaaaaatgattgacgcttcagtggatcaaataagagggtacagggtcgacgttaacaataagccagaaatgcatacattcgaggtgtatcggaagatgcagagtctggaaaccatcagcgtaggagagttgtctcgcaacgtgctagatgaactggcccacattctcacgctgaatactgagagagagggtatggaagaggcgatcaacacaaaacttaaggactccttctcacaggatcaagtcctggaattggtgcagtttaggaaaaataacagcagtctcttctctaagggctggcataatttttccctgaaattaatgatggagctgatacccgagctatacgaaaccagcgaggaacagatgactattctcacacgtctggggaagcagaagtcgaaagagacctctaagcggacgaaatacatcgacgaaaaggagcttaccgaggaaatctataaccctgttgtggccaaatccgtccgacaagcaattaagatcattaatgaggctacaaagaaacacggaatattcgataacatcgtgattgaaatggccagagagaacaatgaagaggacgctaagaaagattacatcaagaggcagaaagccaaccaggacgagaagaatgcagccatggaaaaagctgcgtttcagtataacggcaagaaggagttgccagacaatatcttccacggtcataaagaactggcaactaagattcgcctctggcaccaacagggggagaaatgtctgtacaccggcaagacaatacccatctcagatcttattcataaccagtataaatacgaaatcgaccacattctgcctttgagtctcagctttgatgactccctgtctaataaggtattagttctggccactgctaaccaggagaagggacaacggaccccattccaggccctagatagcatggacgatgcatggtcatatagagagtttaaaagttacgtgaaggaatccaaactcctgggcaataagaaaaaggagtaccttttgacagaagaggacatcagcaagatagaggtcaaacagaagttcatcgaaaggaacctgattgatacccgctattcttcacgagtggtcctcaatgccctgcaggacttttacaaagctcacaagttcgatactacgatcagtgtggttcgggggcaatttacaagccagttacgtagaaaatggggactggagaagtccagggaaacctatcatcaccatgccgtggacgcacttattatcgcggcttcttcgcagttgcgcctctggaagaaacaaaacaatagcctgatatcctacaaggagggtcagttcgtagattcagaaactggcgagattatcagtctaaccgacgacgagtataaagaactggtcttcaaggccccgtacgatcactttgtggacacactccggtctaaaaagttcgaggatagcattctgttttcctatcaggttgactcaaaattcaacagaaagatcagcgatgcaaccatatacgccactaggaaggctaaacttgacaaggaaaagaaggagtacacatatacgttggggaaaatcaaggatatttactctctgggaaccaaggccccctccaaaactggcttttataagttcttagacctctacaataaagataagagtcagtttctgatgttccaaaaagaccgaaagacatgggatgaagtgatcgagaagattatggagcagtatcgcccttttaaagaatacgacaagaccggtaaacttgtcgatttcaacccatttgagaagtatcggcaggaaaacgggcccatcagaaaatacagcaagaagggcaatggacctgagataaaatctctgaagtactatgacattttgctcggcaaacataagaacatcacaccagaagggtccaggaatactgtggcactgctatcactgaacccctggcgtaccgacgtatactataatatggagacgaaaaagtacgagttcctcggactgaagtatgctgatcttccgtttgaagagggtggcgcctacgggatcagtaccgaaacatataacgagttgcgcgagaaagaaggaattggcaagaatagcgagttcaaattcactctgtacaagaacgacttaatcctcattaaagataccgaaacaaattgccagcaaatatttcggttctggtcgagaactggtaaggacaaccctaaatcctttgagaagcacaagatcgaactgaaaccctacgagaaggcgaggttcgagaaaggggaggagcttaaggtgctgggcaaagttccaccttctagcaatcagctacagaagaacatgcagattgaaaatctctcaatctataaggtcaaaaccgatgtgctgggaaacaagcactttattaaaaaggagggcgacgaacccaaattgaagttctga

SEQ ID NO: 2833 - RNA, 3405 nt, synthetic construct
  misc_feature 1..3405: note = Cas9 variant
  source 1..3405: mol_type = other RNA
atgaacggcctggtgctcgggcttgacataggaattgccagcgtcggtgttggcatactggagaaaaattccgggaaaatcattcacgaaaactctagattgttccccgctgcaaccgccgataataacgtggagaggcggaagaatcgccaggcgcgacgtttaaacagaaggaaaaagcatcggggagtacgctttcaagacctgttcgaagattacggcctactcacagacttttcaaaagtgagtatcaatctgaacccttatagacttagggtcgatggtctgaatcagcagttgactaacgaggaactcttcattgctctgaagaatatcgtgaagcggcgcgggataagctacctggacgatgcctccgaggacggaggcacggttccatctgattatggcaaagcagtgaaggagaaccgaaaactcttagccgaaaagaccccggggcagatccaactggagagatttgaaaaatacggacagcttaggggtgacttcacagtcgaggagaatggcgaaaagtgccggttgattaacgtgttttcgacttcagcttataagaaagaggcagaacgtatcctgcgcaagcagcaggagttcaataaccaaattaccaacgaatttatcgaggattacctaaaaatactcacagggaagagaaaatattaccacggacccggcaatgaaaagagcaggaccgactacggtcggttccgaactgatgggacaaccctggacaacatttttggaatccttattggcaaatgtacgttctatcctgaagagtaccgcgtaagtaaggcctcctatactgctcaggaatttaatatcctgaacgacttgaataacctcaccgttccaacagagactaagaaactgtctgaggagcagaagaaagatatcgtggagtacgccaaggaaaccaaaacattaggcgcgagcaccctgctcaagtatattgcaaagatgatagacgcctccgtcgatcagatcagagggtacagggtggacgtgaataacaaacccgagatgcatacgttcgaagtctatcggaagatgcaatcacttgagactattagtgttggagaactgagccgcaatgtgttggatgagctagctcacatcctgacactcaacaccgagagagaaggtatagaggaagccattaatactaaactgatgggcgtattctctcaggaccaggtgcttgagctggtccaatttaggaagaacaattcctcattgttcagcaaagggtggcataactttagtctcaagctgatgatggagttaatccctgaactgtacgagacatctgaggaacagatgaccatcctaacgcgtctcggaaagcagaaatccaaggaaaccagcaaacggacaaagtacattgatgagaaagaggtgactgaagagatctataatccagttgtggcaaagtcggtccgacaggctattaagataatcaacgaagccaccaaaaagtacggcattttcgacaacatcgtgatcgagatggcgagagaaaataacgaggaggatgccaaaaaggactatattaaaaggcaaaaggcaaatcaggatgaaaagaacgctgccatggagaaggctgcctttcagtacaatggtaagaaagaactgcccgactctatattccacgggcacaaggagcttgcaacaaaaatccgcttgtggcatcagcaaggcgaaaagtgcctgtatactggcaaaaacattcctatctccgacctcattcacaatcagtacaagtatgagatcgatcatatactgccactttcactgagttttgacgatagcttgtccaacaaggtactcgttctggccaccgctaatcaggagaaaggacagcggacaccgttccaagcgttagactctatggatgacgcatggagctacagagaatttaagtcatacgtgaaagatagtaagctgctatccaacaaaaagaaggactatctcctgaccgaggaagatatcagcaaaattgaggtcaagcagaaattcatcgagaggaatcttgtggacactcgctactcttcacgagtcgtgttgaacgccctgcaggatttttataaggctcacaaattcgacacgacaattagtgttgtgcgggggcagtttaccagccaactccgtagaaagtggggactggaaaagtccagggagacttaccaccatcacgccgtagatgcattaatcatagccgcttcttcgcagctgcgcctttggaaaaagcagaataaccccttgattacctataaagaaggtcaattcgtcgacagcgagacaggcgaaatcatttccctcaccgacgatgagtacaaggagctggtgttcaaagccccttatgaccattttgttgatactctacggtcaaagacattcgaagacagtatcctgttttcttaccaggtggatagcaaattcaatagaaagatatccgacgcaacgatctacgcgaccaggaaggctaaactcgataaggagaaaaaggaatatacttacacactggggaaaattaaggacatctattcacttggaaccaagacaccaagcaaaactggcttttacaagttcttggatctgtataacaaagacaagtctcagtttttaatgttccagaaagatcgaaagacctgggacgaggtcattgaaaagatcatggagcaataccgcccctttaaagagtatgataagacgggtaaactcgtggacttcaacccttttgaaaagtaccggcaggagaatgggccaatatgtaaatactccaagaagggcaacggacccgaaattaaaagtctgaagtattacgacatccttctgggcaaacacaagaatatcaccccggaggggagcagaaacacagtagccttgctctctctgaatccttggaggactgatgtgtattacaacatggaaaccaaaaagtatgagttcctaggactgaagtacgcagacctcccctttgagaaaggtggcgcctatgggatttccacagaaacttacaataagctgcgtgagaaagaaggaatcggcaagaactcagagttcaaattcaccctttacaagaatgatttgattctgataaaagacacggagacaaactgccagcagatctttcgcttctggagtcggaccggtaaggataatccaaagagctttgaaaaacataagattgagttaaaaccttatgaaaaggctagattcgagaaaggggaggaactcgaggttctgggcaaggtgcccccatcgtccaaccaatttcagaagaatatgcagatcgaaaacctttctatttacaaagtcaagactgacgtgctgggcaaaaagcacatcatcaaaaaggagggagatgaacccaagctaaaattctga

SEQ ID NO: 2834 - RNA, 3405 nt, synthetic construct
  misc_feature 1..3405: note = Cas9 variant
  source 1..3405: mol_type = other RNA
atgaagtacatcgagagcgtgtccattggcttcgacataggggtcggatctgttggttatgccgtgatcaactcaaaaaccaagcagattctggaaagtggcgtaagcatctttcccgctgcagtggcccagaaaaatgtcgagagaagggaatcccggcaatctcgccgactccgtagaaggcgggtgaaccgccttaatgatctgaagaaattgttaaagaagaacgggttcattccttcgccaaataaaaacccgtacgagatcagagttaggggactggaacaccagctatcacgggacgagatagcgatcgctgtgctccatattgccaagcgccgaggcatcagctatagtctggatgacgtcgtggatgagaatgtaacagactttaaaggtaagattgccaaaaaccaggaagcacttaagaataagactcccggggagatccaatacgaaagactgttgaaatatggaaaggttaggggcacggtgaccaactacgtcgagtatgatgagcagcctgaatacttcctcaatgtgtttccaaactccgcttacgtggacgaggcaaaacggatactgacatgccagaagcagtattaccccgaaattactgatgacctgatcgagaatattgtcaaaatcatctctcgtaagcgcgcctattacattggccctgggaacgagaaaagcagaaccgattatggaatatacaggacaaatggtgaaaccctcgagaacatcttcgaaattttaatcggcaaggactccgttaacccagatgagctgcgggctcccgccaattcacttactgcgcaagtgtataacttgctgaatgacctaacaaacatacgatacaatgggagtgaacgcctcacccctgagcagaagcaggacattctgagcgaacttctgacgactgagaaaaccgtacagatgttgaacgtgatcgcaaagaaagtcaatgtgaagaaagaggaaatctctggatttagaacaaagaaggatgacaaaccagatttccacactctcgaggtttacaggaaggtgcggaaacatatgctgaacaagggcattgacatcaatgaatggccgaccgagtgttttgatgaattagccttcatttttaacctgaatacagagataggtgagatccgcaacagaatttccgaaaaagtcgtgcccaagtatgacttcatcaccaatcaaatcgtagatgacctccttgaggatcctaagatttttgctatatcaacgagccagaaatggcacaggttcagtatcaagactatgaacgttctgattccagaattgctaaatgggtacaacgagcagatgacaatcctgacccgtatgggactcctggaggactctaaaaacgattattccaatattgacaagatcgacatcaaaaacgtgactgaaaatatatacaaccccgtcgtgcgaaagagcattaagaaatgccttaagatcttcaatgagctgtataaaaagtaccctaacatttcggatgtcgtgatcgaattgccacgggaggacaatcccgaagatgccagaaaactcataaagaaaatgcaaaaggagaacctggttgagaaggacacatctttagaagcatttaggaaagaggctaatctgtccgaaaacggcctaattgatttcctccgcaagggcaaaaatcgggccctgaagatcagactttggtatcagcaggaggggaaatgtttgtacaccggagaaccgattctggcggaggacctctgcaagaacgaggccaattacgatatcgaccatataatccctatttcagtgagttttgatgacagcatcaacaataaggtactgtgttcctctcacttcaacaggtttgaaaaagagaagaaaacgcccttcgaatattttagcaacaagtcaagtcaccttggtcgctactccaatttcgatgagtttcgagcaagcgtcaacgctaataaacggatttctgacgtgaagcgtaagaacctgttgtcaaaagaactcctgagtgatttagacaccagaaagaaattcatcgccaggaatctggttgacacacgctatgctagccgggtggtctttaacgagctaactcagttctttgcctccaagaaagcagataccaaggtggccgtaataagaggcaagttcacatctcaactcaggcgagcttggcagctgaataaatcgcgcgacacttaccatcaccatgcggtggatgcagcccttattggggttaccccattcttgaagatctggcggagcggaaaaacaatctatcctagaaagatgaccgaggctcagactgactttgaactgaacgagattacgacaaatgatgagttcaaagaatcctactatcagctcccctgcccacaatttctggactacttaacccagatgcaggagaacctgaagatcaatttcgaagtcgataaaaagatgaacaggaagatttcagacgccatgatatacagttctcgtaaaaagaaacttagcaaggataaaaaggagaaggaatattccttgggcactatcaatgacatttactcagatgcaggttatagcaaatttaagaacatctacaaaaaggacaaagagaagttcctcatgtatcacctggatcacaagtcttttgaaattctagaggacatcatatcccagtaccccgacaaagaggaatatatcgatagtgaggggaaggtgaaacaacgcgccgtgagccctttcgaaatttaccggagaaagtacggctatatcaggaaatactctaagaagaataacggaccaattatcaaaaacatgaagtattacaatgagaacctgccgaaaatatatattgacatcacccccaagcagtccatcgataaaaaggtctacctcacaaatatttcaccttggcgaaccgacgtttattacaaccggagtcagaatagctaccatataatgggcatcaagtattcggatctgcgctacattgacgggaaatatggaatcccaaagaacgtgtacgaaaagattaaacttagagagaaaatcccctccgagtctgaattttgtttcagcttgtataagaatgatagggtgaaaataatcgaccctaacaagaatgaggaaattgagctgcggtttaactcacgaactttaccaagtgtactcaattacgtcgagttcaagcccctgtttcaggaatcctataactctcttacactgttgccggtgttcagcaaaacgacctccgagggtagaatcattaagaaattcactcgcgaagataatatcgtttacaaggtgaacacagacgagctcggcaatccttactatatactgaaagaatcacaaaacccaaagaatattatcgataacagcaacaagaccgagtga

SEQ ID NO: 2835 - RNA, 3405 nt, synthetic construct
  misc_feature 1..3405: note = Cas9 variant
  source 1..3405: mol_type = other RNA
atgaacggcctggtgctcgggcttgacatcggaattgccagcgagggtgtcggcatactggaaaagaactccgggaaaatcattcacgctaattctagattgttccccgcagccaccgcggataataacgttgagaggcggaagaatcgccaggctcgacgtttaaacagaaggaaaaagcatcggggagtgcgctttcaagacctgttcgaagattacggcctactcacagacttttcaaaagtaagtatcaatctgaacccttatagacttagggtggatggtctgaatcagcagttgactaacgaggaactcttcattgccctgaagaatatcgtcaagcggcgcgggataagctacctggacgatgcatccgaggacggaggcgccgtgtcttcggattatggcaaagctgttgaggaaaaccgaaagctcttagcagagcagacgccagggcaaatccagctggaaagatttgagaaatacggacaggtgaggggtgacttcaccgtcgtggagaatggcgaaaaacttcggttgattaacgtattttcaacaagcgcctataaaaaggaggctgaacgtatcctgcgcaagcagcaagagttcaataaccagattactgatgaatttatcgaggactacctaaaaatactcaccgggaagagaaaatattaccacggaccgggcaacgagaagagtaggacagattacggtcggttccgaaccgacgggactacactggacaatatttttggaatccttattggcaaatgcaccttctatcccgaagagtaccgcgcctccaaggcgtcttatacggcacaggaatttaacctgttgaatgatctcaacaatctgactgttcctaccgagacaaagaagttaagcgaggaacagaagaaagtgatcgtcgagtacgccaaggaagctaaaactctgggcgcctccaccctccttaagtatatcgcaaaaatgattgacgcttcagtggatcaaataagagggtacagggtggacgtcaacaataagccagagatgcatacattcgaagtttatcggaagatgcagagtctggagaccatcagcgtgggagaattgtctcgcaacgtactagatgagctggcccacattctcacgctgaatactgagagagaaggtatggaggaagcgatcaacacaaaacttaaggactccttctcacaggatcaagtgctggagttggtccagtttaggaaaaataacagcagtctcttctctaagggctggcataatttttccctgaaattaatgatggagctgatacccgaactatacgagaccagcgaggaacagatgactattctcacacgtctggggaagcagaagtcgaaagaaacctctaagcggacgaaatacatcgacgagaaggagcttaccgaagagatctataaccctgtggttgccaaatccgtgcgacaagcaattaagatcattaatgaagctacaaagaaacacggaatattcgataacatcgtcattgagatggccagagaaaacaatgaggaggacgctaagaaagattacatcaagaggcagaaagccaaccaggacgaaaagaatgcagccatggagaaagctgcgtttcagtataacggcaagaaggaattgccagacaatatcttccacggtcataaagagctggcaactaagattcgcctctggcaccaacagggggaaaaatgtctgtacaccggcaagacaatacccatctcagatcttatttataaccagtacaaatatgagatcgaccatattctgcctttgagtctcagctttgatgactccctgtctaataaggtgttagccctggctactgccaaccaggagaagggacaacggaccccattccaggcactagatagcatggacgatgcctggtcatacagagaatttaaaagttacgtaaaggacctcaaatccctgagcaataagaaaaaggattatcttttgacagaggaagacatctctaagatagaggttaaacagaagttcatcgagaggaacctggtggatacccgctactcaagtcgagtcgtgctcaatgctctgcaggacttttataaaagccaccaattcgatactacgatttccgtcgtgcggggccagtttacatctcagttacgtagaaagtgggggctggaaaaatcgagggagacctaccaccatcacgccgttgacgcacttatcattgcggctagctcccaattgcgcctctggaagaagcagaacaatccgctgatcacttataaagaaggacagttcgtggactcacagaccggtgagataattagtctaacagatgacgaatacaaggagctggtattcaaagccccctatgatcattttgtcgacaccctctctagcaagactttcgaggattccatcctgttttcataccaagtggacagcaaattcaaccggaagatttctgatgcaacaatctacgccacgagaaaagctaaacttgacaaggaaaagaaggagtatacctacactttgggcaaaataaaggatatctattccctggggacaaaaacccctagtaagacaggattttacaagttcttagacctctataataaagataagagccagtttctgatgttccagaaagacaggaagacttgggatgaagttattgagaaaatcatggaacagtaccgaccatttaaggagtatgacaagaccggcaaacttgtggacttcaacccctttgagaagtaccgccaagaaaacgagcctattcggaaatactctaagaaaggtaatgggccagaaatcaagtccctgaagtattacgatatattgctcggcaaacacaagaacattacgcccgagggatcaagaaataccgtcgccctgctaagtctgaacccgtggaggacagacgtgtattacaatatggaaactaaaaagtatgagttcctcggcctgaaatacgcagatcttccttttgaggaagggggagcttatggtatcagcaccgagacatacaacgaattgcgtgagaaggagggcatcgggaaaaattcggagttcaaattcactctgtacaagaacgacttaattctcatcaaagataccgaaacgaattgccagcagatttttcgcttctggtcccggacaggaaaggacaaccccaaatcttttgaaaagcataaaatagagctgaagccatatgaaaaggccagattcgagaaaggcgaggaacttgaggtactgggtaaggtgcctcccagctcaaatcagctacaaaagaacatgcagatcgaaaatctcagtatttacaaggttaaaaccgatgtcctggggaacaagcactttatcaagaaagagggcgacaagccaaaattgaagttctga

SEQ ID NO: 2836 - RNA, 3408 nt, synthetic construct
  misc_feature 1..3408: note = Cas9 variant
  source 1..3408: mol_type = other RNA
atgagcgacctggtgctcggccttgatatagggattggatccgtcggtgttggcatactgaacaaggtgaccggggagatcattcacaaaaattctagaatcttccccgccgctcaggcagaaaacaatttggagaggcggacaaaccgccaaggacgacgtttaactagaaggaagaaacatcggcgcgtaagactgaatcacctatttgaagagtcaggcctcattacggacttcaccaaggtgagtatcaacctgaatccttaccagcttagggtcaaaggtctgacagccgaattgagcaacgaggagctctttatagcgctgaagaatatggtgaagcatcgggggatctcctatctggatgacgcttctgatgacggaaactcgtcagttggcgattacgcccagattgtgaaagaaaatagcaagcagctcgagactaaaaccccaggccaaatccagttagaacgctatcagaagtacgggcagctgcgaggagacttcacagtcgaggaggatggtagaaaacacaggcttattaacgtgtttccgaccagtgcatatcatgccgaggctttgcggatcctgcaaactcagcaggagttcaatccccagataacagacgaatttattaactcctacctagagatcctcaccggcaagcgtaagtattaccacgggcctggaaatgaaaaatctcgcacggattacggcaagtatactaccaaaaaggacgcacaaggtcagtacattacactgaacaacatcttcgggatccttattggaaaatgcactttttatccagaggagtacagagccgctaaggccagctataccgcgcaggagttcaatctgttgaacgatctcaataacctgacagtacccaccgaaacgaaaaagttatccgaagaacaaaagtaccagataatcacttatgttaaaaatgaaaaggcaatgggccctgccaaactgtttaagtacattgctaaactccttgcctgtgacatcgcagacataaagggctacaggattgataagtcagacaaagctgagatccacacattcgaggcctatcggaagatgaaaaccctggaaactatcgatattgagcagatcgaacgagagaagttggacaaactagcgtacgtgctgacactcaacaccgaacgcgaggggattcaggaggccctggatcatgaatttgcagacggaacgttcagtcaagagcaggtcgatgaacttgtgcagttcagaaaggctaatagctctatatttggtaagggctggcactccttctcagtgaaactgatgatggagttgatcccagagctctatgccaccagcgaggaacagatgacaattctgactaggttagggaagcaaaagaccacaagttcttccaacaagactaaatacatcgacgaaaagcagctgaccgaggaaatctataatcccgtcgttgctaagagcgtgcggcaggccattaaaatagtaaacgcagccatcaagaaatacggagattttgacaatattgtgatcgagatggctcgcgagacaaacgaagatgacgagaagaaagcgattcagaagatccaaaaagcaaataaggccgaaaaggacgctgccatgagaaaagcagccaaccagtataatggcaaggctgagctacctcattcggtcttccacggtcacaaacagctcgccaccaagataaggctgtggcatcagcaaggggaacgttgcctttacactggcaaaacgatctctattcacgatttgatcaacaacccaaatcagtttgagattgaccatatcctgccgctctccataacattcgatgactcactggcaaacaaggtgcttgtttacgcgaccgctaatcaggagaagggacaacggactccctatcaggccctggatagtatggacgatgcatggagctttcgagaattgaaagccttcgtgagagagtccaaggctctctctaacaaaaagaaagaatacctgttaaccgaggaagacattagcaagtttgatgtcaggaagaaattcatcgagcgcaatctggtggacacacggtatgcctcaagagtagttctaaacgcactccaggagcactttaaggctcataaaattgataccaaggtgagtgtcgtgaggggccagttcacttcccaactgcgccgacactgggggatcgacaaaacacgggatacgtaccaccatcacgccgtcgacgcgcttataatcgccgctagctctcagttgaatctgtggaagaagcagaaaaacaccctcgtgtcatatagtgaagaccagctgttagatattgagactggagaactgatcagcgacgatgagtacaaggagtccgtttttaaagcaccttatcaacatttcgtggacacacttaagtctaaagagttcgaagattcgattttgtttagctaccaggtagactccaagttcaatcgtaaaatctcagatgccaccatatacgctacaagacaggccaaggtcggtaaggacaaaaaggatgaaacttatgtgctcggcaaaattaaggacatctacgcactggggaccaaaacgccaagtaagaccggattttataagttcctagatctgtacaacaaagacaagtctcagtttctcgtttatcaaaaagataggaagacatgggacgaggtgatcgagaaaattatggaacagtaccgccccttcaaggagagcgacaagaatggcaaagaagtcgattttaaccctttcgagaagtatcggatcgaaaatggtccaattagaaaatactccaggaaggggaacggccccgagataaaatcactgaagtactatgcgagcaaacttggaaatcacatcgacattactccgaaagattctaacaacaaggtggtattgcagtccgtgagtccttggcgagccgacgtttactttaataaaaccacaggcagctatgaaatcctggggttaaagtacgctgatctccaattcgagaaaggaactggtacctatcgcatttctgaggaaaagtacaacgacatcaagaaaaaggagggcgtcgattccgactcagaatttaaattcacgctgtataagaatgatcttctgttgataaaagacacagagaccaaggaacagcggctctttagattcctgagtaggagcatgcccaacaaaaagcactacgtggagctaaagccatactcgaaagataagttcgagaaaaatgaatccctgatcgagattctcgggtctgccgacaagagcggacgttgtatcaaaggcctggcaaagtcaaaccttagtatttttaaggtgcgcactgacgtcttgggtaatcagcatatcatcaaaaacgaaggggataagcctaaactggacttctga

SEQ ID NO: 2837 - RNA, 3408 nt, synthetic construct
  misc_feature 1..3408: note = Cas9 variant
  source 1..3408: mol_type = other RNA
atgggcgtgatcttcctgtacgagaacattgtcaagccctttcctagcagatatgacaaagccataatgaagaggctcaaagggcggcagaccatgggatacatcctttccctggatattggtatcgcttcttgcggctattcagttttggaaacagacgcattaggggtgccatacaagattaaaactctgaatagtatcatattcacgcgcgccgagaacccgaagaccggagcgagcctagctgaaccccgacgtaagtatagaggcgccaggcggcgcaaaagaaggacatcctttcggaagcaccgcactcgacaactcttcatcacctctggtctgctttcgaaacaggatattgcaagatacctgaatcagcaggagcctcatgacgatatctgggaattgagggtaaaggggctcgacgagccactgacaaacctgcaactctttcaggtgttatattacttcgtcacccaccggggatttaaatcaaatcgtaaggccgagctgaaggataaagacattggccccgtgcttaacagcatcaatgctttcaaggaagagatgcagagtcatgattaccgcactataggcgaattgtatgcaaacgaccctagatttagggatcggaaacacaataaggactacacaaacgggttcctgggaaccattcagcgatcctggctagttgatgagatcaaaatgctcctgacgaatcaacagtcttttggtaacactcagcttaccagcgagttcattgaactgtatttgaatatctttacatcccagcgcaacttcgacgacggcccagcctcagggccctacagtggagatctcatcgacaagatggtgggccctgatactttcaatagaagcaggaaacgggctccacgcgccacctatacatttcaatacttctcttttctgtccaagttaaactcactgagaattgcgccgagcataagtgcacccttcgagaccctcacggtcgaccagagggcccttatcactaagcgtctgtggggtcctgatgtgaaatctgctgacttgaagtttaaacagattcggatggtactatccctgccagaaacagcccgattcaacctcgttaattatgggaacacccccgagaaggcactggaaatcgaggataaaactacatttataagcattaagcctcttagagagatcgaaaaggctctgaccggaacgaccttgccagtgtcgcatgaccaactcgatgccatcgcgaggattctgacagtctacaaatctgactccaatcgcaagactgccttccacaaccagaccgtgttatcagatgaggtgatcgaacagctgctacccctcaattttagtaaattcggccacctgagcgtcgagacaatgcaggaaattataccgtaccttgagcaaggcatggtttattccgacgcagctactgccgctgggtacgactttcggaacaatcagatcgatatggagtatattagagacaacgtgaccaatcctgtagtgaggcgcgccgtctctgtggcaaacaagttggttaaagccgtggtccgacggtacggaaagcccgatagcatccatatcgaactggctcgtgacctctcacagaatttccaggagagaaggcaagatgaagtgcgccagcagaagaacgcgcgggacaatgagaaaattgcaaagagactggaggaacttggtataccagtaaacggcgttaatatcacaaaaatgaagctgtatgatgagcagcacgggattgacttgtacgatctcagtaccaacgcctccatggctgtgactgacatctttagcgatgacaggtatgaaattgatcatatcataccttactctgtctcattcgacgacagttacacgaacaaagtgctggtcagcgccaaggcaaatcgagagaagcgcgatcggatccccatggaagtgttcggaaacgactccgagagaaggcgtcaatttgagaatcgcgttaacacaaatattaccaacttacggaaaaagagaaatctgctaaaagaaactttctctgatgaggacaaggccaaatggaagtcgaggaacatcaatgatacccgatatctcaaccggattctgatgaattaccttagccagaacgtggaatttacagacgtattgtccgatgctaaacacgtcatcgccctgaatggcgcagtgaccgcgaagatacgctcaagatggggtattactaaggttagggctgccggggacctccaccatgcagtggatgccgtcgtgatcggctgtgtaacagacgctctgattcaggccgtgacgcggtatgcaaaataccaggagcgaagagataacaaggctgccgcggaacaagacttagccgagaataacccagaggaactggatgctaaacagttccgcaaggtttttaacgactatccccttccttggccagagttcagggaagagttgatgggacgtgtcagttctgacccgagccagatcatggcaggccggcaatggtcccactacaccgccgaagagatatcagagctcaaacagccctttgtggtgagagtccctaatcataggatcgttgggccagctactctggatacagtgtatggacagcccaaccctgacgatggtctaattacccagcgcgtgcgaatcacagacctgaagccacaaaagaataaagatggcgaagacattatcaaggccggggcaaacgtatacgagctcgcggccgatggaggcaataaactggtctacgaaagcatacttgacgctttgcaagtggccggtggggatggcaagaaagcattccccactggaagactgttagttcggtctccgattcaggacatccctgtggagagggtccgcgtgacctccaaggctacgctcgttgtgccagtaggccccaagagtgtcgccgcaaacgggagcatggtgcgtatcgatgtgtataaaacccctaagaaatacgtctttgttcccatttatgtgagagacacagtaaaggccgaactgccagaccgggctgtggcgcctgtcaaaccctactctcagtggtatcagcttcagccaaaggatcagttcctgttttccttgttcgccaatgacctcatcaggtttaagcacccgcgcggagtgtcaactaaagagattctgaccgatggtagtcaggagaagggcaaacgaacagacgttgtggggtacttcactggagcagatatagctaccgccagcatcgccattgaaggccctgacagatcgttctccgctcggggtatcgggtttgcatctctaaagaacgtcgagaaactgacggtgaattatttcggcgaactccatagcgttcacgagacacaacccatgcagtttaggggacagcgcggctga

SEQ ID NO: 2838 - RNA, 3411 nt, synthetic construct
  misc_feature 1..3411: note = Cas9 variant
  source 1..3411: mol_type = other RNA
atgaacggcctggtgctcgggcttgacatcggaattgccagcgtcggtgttggcatactggagaaggataccgggaaaatcattcacgcttcctctagattgttccccgcagccacagcggacaataacgtggaaaggcggtcaaatcgccagggacgacgtttaaacagaaggaagaaacatcggagtgtacgcctgcaagatctatttgagagctacggcctcctgactgacttctccaaactttctatcaatctgaacccttatcagttgagagtgcagggtatggaaaatcagctcacgaacgaggaactgtttattgctctgaaaaatatcgtcaagaggcgggggatatcgtacctcgatgacgcctcagaggatggaggcaccgtgagcagtgactatggcaaggcagttgaggaaaaccgccgattactgacagagaaaactccagggcaaatccagcttgaaagattcgagaagtacggacagttgaggggtgattttaccgtggaggaaaatggcgagaaacggcgtctgattaacgtcttctccacatctgcctatcgcaaggaagctgagagaatcctaaggaaacagcaagaatttaataacaagattaccgacgagttcatcgaggattacctcactatactgacagggaagcggaaatattaccacggaccgggcaatgaaaagagccgaaccgactacggtcgctttagaacggatgggactacccttgacaacattttcggaatcctgattggcaaatgcacattttatcccgaggaatacagggcatccaaggcctcatatactgctcaggagttcaacttgctcaatgacctgaacaatttaaccgtgcctacagaaaccaaaaagctgagtgaggagcagaaaaagacgatcatcgaatacgccaagagcgcgaaaactctcggcgcatctacacttctgaagtatattgccaaaatgatagatgcttccgtagaccagatccgggggtaccgcgttgatgtgaacaataagccagagatgcatacctttgaagtctatagaaaaatgcaatcattggagactattaaggtggaagaactacccaggaaggtgctggacgagctcgcccacatcctgacacttaacaccgaacgtgagggaatagaagaggcaattaatagcaaactgaaggatacgttcaaccgggaccaggtcttggagctcgttcagttccgaaagaataacagttctctgttttccaagggttggcataatttcagcttaaaactgatgatggaactaatccctgagctctacgaaacctcggaggaacaaatgacaatcctgactagacttggcaagcagaggtctaaggagacctccaaacgcacaaagtacattgatgagaaagaattgactgaggaaatctataacccagtggtagctaagtcagtgcggcaggccattaaaataatcaatgaggcgaccaagaagtacgggatttttgacaacatcgtcatcgaaatggccagagagaataacgaggaagatgcaaagaagaactatattaaacagcaaaaggctaatcaggacgagaaaaacgccgctatggaaaaggccgcattccagtacaatggcaaaaaggagctgcccgataacatatttcacggacacatggaactcgccacaaagatcaggctgtggcatcagcaaggtgagaaatgtctttataccgggaagaatattcagatcagtgacctgattcacaaccagtacaaatatgagatcgaccatatattgcctctcagcctgtccttcgatgactctttaagcaataaggtgctggttctagctactgcgaaccaggaaaaaggccaacgcacgccatttcaggcactcgattcaatggacgatgcctggagttaccgagagttcaagtcctacgtgaaggaaagcaaactgcttggaaataagaaaaaggactatttgctgacagaggaggatatctctaaaattgaagtcaagcagaagtttatcgagaaaaacctcgtggacacccggtactcaagtcgtgtagttctgaatgctttacaggatttctataagaaacaccaatttgacactaccattagcgtggtcagaggccagttcacatcccagctgaggcgcaagtggaaacttgaaaagtctcgggatacctaccaccatcacgccgtggacgcattgatcatagccgcttcgagccaactcagactgtggaagaaacataacaatccgctaatttcctataaggatgggcagtttgtcgactcagagactggagaaatcgtgagtctgtctaacgaggagtacaaagaactcgttttcaaggccccctatgaccacttcgtggatacactgaggagcaaaaagtttgaggactccattcttttctcataccaggtagatagcaaatacaatcgaaagatctctgacgcaacgatatatgcgacccgcaaggctaaattggataaggacaaaaaggaatacacttatacactgggtaaaatcaaggatatttacgccttaggcaccaagacaccttccaaaactgggttttataagttcctcgacctgtacaaaaccgataagagtcagtttcttatgtatcaaaaagaccggaagacgtgggatgaggtcatcgaaaagattatcgagcagtacagaccattcaaagagtacgacaagaacggaaaagaagtggattttaaccccttcgagaagtataggatagaaaatggccctattcgtaaatacagccgcaagggtaacgggtctgttatcaagtccatgaaatattacgacaatctgttgggcaagtttgtggacatcaccccatcagagagtaaaaaccccgtcgcactcctgagcctaaatccgtggcggacagatgtgtattacaaccctgaaactagaaagtatgagttcctgggactcaaatacgccgacctgtgctttggcaaagggggatcgtacggtatttccgaggtaaagtataataaaatcagggaaaaggagggcattgggaaagaatctgagttcaagtttaccctttacaaaaacgatttgatactgatcaaggacacagagactaattgtcagcagttcttccgattttggagccggaccggaaaagataaccccaagtcattcgaaaagcataaaattgagttaaagccatatgaaaaagctaagtttgagaaaggcgaggagctcgaggtgctgggtaaggttcctcccagttccaatcaattccagaagaacatgcagatcgaaaatctttctatttacaaagtcaagacggacgtgctggggaacaaacactttatcaagaaagagggcgatgaaccaaagctaaagttcaaaaagtga

SEQ ID NO: 2839 - RNA, 3411 nt, synthetic construct
  misc_feature 1..3411: note = Cas9 variant
  source 1..3411: mol_type = other RNA
atgaacggcctggtgctcgggcttgacatcggaattgccagcgtcggtgttggcatactgaagaaagataccggggagatcattcacacaaattccagattgttctctgctgcaactgccgactcaaacatcgaaaggcggcgccatcgaggaggcaagcgtttaacgagaaggaaaaagcaccggagtattcgcctgcatgatctatttgaggacagcggtctcctgaccgatttctccaaagtgtctatcaatcttaacccctaccagctgagagtacaagggttggacaatcagctcacaaacgaagaactgtttatagcgctgaagaatatcgtgaagaggcggggaatttcgtatctcgatgacgcttcagaagatggcggcactgtcagcagtgactacgggaaagccgtggaggagaaccgcaagttactggcagaacagacccctggacagatccaacttgatcgattcgagaaatatggtcaggttagaggcgactttacagtggtcgaaaatggggagaagaggcggttgattaacgtgttcaccacttccgcctactctaaagaggctgaacgtatcctgcgcaagcagcaggagtttaataagaaaataacagatgagttcattgagaactatctaaccatcctcacgggaaagagaaaatactatcacggcccaggtaatgaaaagagcaggactgactacgggcggtacaccactaaaaaggacccggagggaaaatatattacactggataacatctttggcatccttattggcaagtgcaccttctaccccgacgagtatcgagcatccaaggcctcatacacagctcaagaatttaatctgttgaacgatctcaacaatctgaccgtacctacggagactaaaaagttaagtgaggaacagaaaaagacaataatcaaatatgccaagaccgcgaagactctgggggcaagcacactccttaaatacattgccaagctgatcggagcttctgttgaccagatacatggttatcgcattgatccaaacaaaaagcccgaaatgcacaccttcgagacgtacagaaaaatgcagtccttggagaccatctcagtggaagagatccctaggaaggtcctagacgaactggcccacattctcacactgaatactgagcgggaaggcatcgaggaggcaattaacgctacccttaaggatacatttagccaagaccaggtgctggaattggtgcagttccgcaaaaataacagttctctcttctccaaggggtggcataattttagcctgaaattaatgatggagctgataccagaactatacgagacttcggaggaacaaatgaccatcctcacaagactgggaaagcagaaatctaaggagacctccaagaggactaaatatattgatgaaaaggagcttacggaagagatctacaaccccgtcgttgccaaatcagtgcgtcaggcgatcaagattataaatgaggccaccaaaaagtatggcatcttcgacaacattgtaatcgaaatggcacgggagaataacgaagaggatgctaaaaagggttacaatgaacgacagaaggccaacttggacgagaaaaagagtgctatggagaaagccgcatttcaatataatgggaagaaagaactgcctgacaacgtgttccacggccataaggagctcgccacaaagattagactgtggcaccagcagggagaaaaatgtctttacactggcaagaacatcccaataagcgatctgatccagaatcaatataaatacgagattgaccacatcttgccgctctccctgtcttttgatgacagcttatcaaacaaggtcctggtgctagctaccgcgaatcaggaaaaagggcagaggacacccttccaggcactcgatagtatggacgatgcctggtcctaccgcgagtttaagagctatgttaaggacctgaaacttttgtctaacaagaaaaaggattacctgctcaccgaggaagacatttcaaaaatcgaggtgaagcaaaagttcatagaacggaatctggtcgatactagatatagtagcagggtggtattaaacgctctgcaggacttttacaaagagcatcagttcgatacaacgatttccgttgtgcgcggacagtttacctctcaacttcgacggaagtggggtttggagaaatcgcgtgaaacttatcaccatcacgccgtcgacgcactcatcattgccgctagctcccagctgagactatggaagaaacagaataaccctctgatctcatacaaggagggccaattcgtggaccaggaaacaggggagataatcagtctctctgatgacgaatataaagagctggtctttaaggccccatacgatcatttcgtggacacccttaagagcaaaaagttcgaggattccattttgttttcataccaggttgacagcaaatataataggaagatctctgatgcaacaatttacgcgactcgcaaagctaagctggacaaggagaaaaaggaatatacctacacgttaggaaaaatcaaggatatatatgccctcggctccgaaaaactgaagaccggtttctacaagtttcttcacctgtataaaaaggacaaaagtcagttcttgatgtaccaaaaggatcggaaaacatgggacgaggtgattgaaaagatcctcgagcagtacagaccctttaaggagaaagataagaacgggaaagaagtagacttcaatccttttgagaagtataggatcgaaaacggcccaattcacaaatacagccgaaagggaaatggccccgtcatcaagtctctgaaatattacgacaagaacattccggagtccttcataaatatcactccttcaaacagtaaaaacaaggtgattctacgccagctgaatccctggcggaccgatgtttattttaaccatcagacagaaaaatacgagctcctggggcttaagtatgcacacttgcaattcgagaaaaagactggaaattacagcatcaccattgacaagtacaacgaaatcaaagagaaggaaggtgtgtcggagcagtccgagtttaaattcacgctgcataagaatgatttactcctgataaaagacacagaaaccaaggagcagcagctttttagattcctgtctaggactaagccaaacgtcaaacactatgtggaactaaagccttacagccgtgatgagttcgagaaaaatgaacgcctcatcgagattctgggctcagtagacaagagtgggcggtttgtgaaaggattgggcaagtccaacctgtctatctataaggttagaacagatgtcttaggtaatcaacacattatcaaaaaggaaggggaggaacccaaactcaagttctga

SEQ ID NO: 2840 - RNA, 3411 nt, synthetic construct
  misc_feature 1..3411: note = Cas9 variant
  source 1..3411: mol_type = other RNA
atgaacggcctggtgctcgggcttgacatcggaattgccagcgtcggtgttggcatactggagaaggataccgggaaaatcattcacgcttcctctagattgttccccgcagccacagcggacaataacgtggaaaggcggtcaaatcgccagggacgacgtttaaacagaaggaagaaacatcggagtgtacgcctgcaagatctatttgagggctacggtctcctgactgacttcagcaaggtgtccatgaatcttaacccttatcagctgagagtccaggggatggaaaatcagttgacgaacgaggaactctttgtggctctgaaaaatatcgttaagaggcggggaatttcttacctggatgacgcctcggaggatggcggcaccgtgtcaagcgactatgggaaggcagtcgaggaaaaccgcaaactcttagccgagaagacaccaggacaaatccagctggaacgattcgagaaatacggtcagcttagaggcgattttactgtggaggaaaatggggagaagcacaggttgataaacgtattcagtacctccgcttatcggaaagaagcagagcgtatcctgcgcaagcagcaagaatttaattctaagattacagacgagttcatcgaggattacctaattatcctcaccggaaaaagaaagtattaccatggcccgggtaacgaaaagagcaggactgactacgggcggtttcgaacagatggaaccacgctggacaatatattcggcattcttatcggcaagtgcactttttataccgaggaataccgcgcctccaaggcttcatatacagcccaggagttcaacctgttgaacgacctcaataacctgactgttcccaccgaaacaaagaaattaagtgaggagcagaagaagctgattatcgaatacgcgaaaagcgcaaagaccctcggggcctctacgcttctgaaatatatcgctaagatgattgatgcctccgtggaccagataagaggatacagggtcgatgtgaataacaaacctgagatgcacacttttgaagtgtatcggaagatgcaatcattggagacaatcaaggtcgaagaactaccacgcaaagttctggacgagctcgcacatattctgacccttaatactgaaagagagggtatcgaagaggctataaacagcaagctgaaagatattttcaatagggaccaggtgttggagctcgtacagttccgtaagaacaatagttctctgttttccaaaggctggcacaacttcagcatcaagttaatgatggaactgatccccgagctatacgaaacatcggaggaacaaatgaccattctcacgcggctggggaagcagcgatctaaagagacctccaagagaacaaaatacatcgatgagaaggaacttactgaggaaatttataatcctgtggtcgccaaatcagtgaggcaggcgataaagatcattaacgaggccaccaagaaatacggaatctttgacaatatcgttattgaaatggcacgcgagaacaatgaggaagatgctaagaaagactatataaagcggcagaaagccaaccaagatgagaagaacgctgccatggaaaaagcagccttccagtacaatggcaagaaggagttgccagacaacatctttcacggtcataaagaactgacaactaagattagactctggcaccagcagggggagaaatgtctgtataccggcaagaatatccccattagtgaccttatccataaccaatacaaatatgagatagatcacatcctgcctttgagcctctccttcgacgattctctgagcaataaggtgttagtcctggctacagcgaaccaggaaaagggacagaggaccccatttcaggcactagactcaatggatgacgcctggagttaccgcgagttcaaatcctacgtgaaggatagcaaactcctgtctaataagaaaaaggactatcttttgactgaagaggatatttcaaagatcgaggtaaaacaaaagtttattgaacgaaacctggttgacacgcggtacagtagccgtgtggtcctcaatgctctgcaggatttctataaatcccaccagttagacacaaccatctctgtggtcagaggccagtttacttcgcaactgaggcgcaagtgggggatagagaaaagccgggaaacctaccatcaccatgccgtggatgcacttattatcgccgcttcctcacagttgagactctggaagaagcacagtaacccgctgattgcctataaagagggacagttcgttgactctgaaacaggtgagatcgtgagcctatccgacgaggaatacaaggagctggtatttaaagcaccctatgatcatttcgtcgacaccctcaggtcaaagaaattcgaagatagcatactgttttcttaccaagtggactccaagtacaatcgaaaaatcagtgatgcgactatttatgctacacgcaaggccaaacttgacaaagagaagaaagaatacacgtataccttgggcaagatcaaagatatttacgcactggggactaagacacctagcaagaccggattctataaatttttagacctctacaagacagataaatctcagttcctgatgtatcagaaggaccggaaaacttgggatgaggttatcgagaagataattgaacagtacagaccatttaaggagtacgacaaaaacggcaaggaagtggatttcaatccctttgagaaatataggatcggtaacgggcctatccgtaagtactccaaaaagggcaatggaccagaaattaagtcacttaaatattacgacatcctgttgggcaagcacaaaaacattacccccgacgggagtcgcaacacggtcgccctcctgagcctaaatccgtggcggaccgatgtgtattacaactcggagacaaagaaatatgagttcctgggactcaagtacgctgacctgtgctttgaagagggtggcgcctacgggatatccgaagtaaagtataaaaagatcagagagaaagagggaattggcaaaaattctgagttcaaatttactctttacaagaacgatttgatcctgattaaagacaccgagacaaattgtcaacagttctttaggttctggagccgaactggtaaggataaccctaagtcattcgaaaaacacaagatcgagttaaaaccctatgaaaaggcaaaatttgagaagggggaggaactcaaggtgctgggcaaagttccacctagttccaatcagttccagaagaacatgcaaatagagaatctttctatctacaaagtcaagaccgacattctgggaaacaaacattttatcaagaaggaaggcgatgagcccaaactaaagttcaaaaagtga

SEQ ID NO: 2841 - RNA, 3420 nt, synthetic construct
  misc_feature 1..3420: note = Cas9 variant
  source 1..3420: mol_type = other RNA
atgagcgacctggtgctcggccttgatatcgggattggatccgtcggtgttggcatactgaacaaggtgaccggggagatcattcacaaaaattctagaatcttccccgccgctcaggcagaaaacaatttggagaggcggacaaaccgccaaggacgacgtttaactagaaggaagaaacatcggcgcgtaagactgaatcacctatttgaagagtcaggcctcattacggacttcaccaaggtgagtatcaacctgaatccttaccagcttagggtcaaaggtctgacagccgaattgagcaacgaggagctctttatagcgctgaagaatatggtgaagcatcgggggatctcctatctggatgacgcttctgatgacggaaactcgtcagttggcgattacgcccagattgtgaaagaaaatagcaagcagctcgagactaaaaccccaggccaaatccagttagaacgctatcagaagtacgggcagctgcgaggagacttcacagtcgaggaggatggtagaaaacacaggcttattaacgtgtttccgaccagtgcatatcatgccgaagcattgcggatcctgcaaactcagcaggagttcaatccccagataacagacgaatttattaactcctacctagagatcctcaccggcaagcgtaagtattaccacgggcctggaaatgaaaaatctcgcacggattacggcaagtatactaccaaaaaggacgctcaaggtcagtacattacactgaacaacatcttcgggatccttattggaaaatgcactttttatccagaggagtacagagccgctaaggccagctataccgcgcaggagttcaatctgttgaacgatctcaataacctgacagtacccaccgaaacgaaaaagttatccgaggaacaaaagtaccagataatcacttatgttaaaaatgaaaaggcaatgggccctgccaaactgtttaagtacattgctaaactcctttcatgtgacgtggccgacatcaagggctacaggatagataagagtgacaaagcagagattcacacattcgaggcttatcggaagatgaaaaccctggaaactttggatgtcaagaaaatggcccgagaggaactagacaagctggcgtacgtgctcacactgaacaccgagcgcgaagggatccaggaggcccttgatcatgagtttgcagacggaacgttcagccaggaacaagtggatgagctggtccagttcagaaaggctaattcttccatctttggtaaaggctggcactcattcagcgttaagttgatgatggaactcattccagagctgtatgccaccagtgaggaacagatgacaatcttaactaggctggggaaacagaagaccacatcttccagcaacaaaactaagtacattgacgagaagcaactaaccgaagagatatataatcccgtggtagctaaatcggtgcggcaggccatcaagattgtcaacgcagccatcaaaaagtacggagattttgacaatatcgtgattgaaatggctcgcgagacaaacgaggatgacgaaaagaaggcgatacagaaaatccagaaggcaaataaggccgagaaagacgctgccatgagaaaggcagccaaccaatataatggcaaagctgaactccctcattctgttttccacggtcacaagcagctggccaccaaaattaggctttggcatcagcagggggagcgttgcttgtacactggcaagacgatctccattcacgatctgatcaacaacccaaatcaatttgaaatagaccatatcctcccgctgtcaattacattcgatgacagtcttgcaaacaaggtgctggtctacgcgaccgctaatcaggagaaaggacagcggactccctatcaagccttggatagcatggacgatgcatggtcctttcgagagctcaaggccttcgtgagagaatctaaagctctgagcaacaagaaaaaggagtacttactgaccgaagaggacatctcaaagtttgatgtaaggaaaaagttcattgaacgcaatctagttgacacacggtatgccagtagagtggtcctcaacgcactgcaggagcactttaggacccataaaatcgatactaaggtgtccgtcgtgcgcggccagttcacaagccagcttcgacggcactgggggatagagaaaacgcgtgacacctaccaccatcacgctgttgatgccttgattatcgcggcctcttcacaactgaatctctggaagaagcagaaaaacactctggtgagttatagcgaagaccagttactggacattgagacaggagaacttatctccgatgacgagtacaaggagtctgtatttaaagctccttatcagcatttcgtcgataccttgaagtcgaaagagttcgaagacagcatactcttttcctaccaagtggattcaaagttcaatagaaaaatcagtgacgcaacaatttacgccactaggaaggctaagctggataaagaaaagaaagagtatacctacacgctaggtaagatcaaagacatttatgccctgggcaccaagacaccatctaagactgggttttacaaattcctcgatctgtataagaaagacaagagccagtttcttatgtaccagaaagatcgccggacctgggacgaagttatcgagaagatattggagcagtatagacccttcaaggaaaaagataagaacggaaaagaggtggactttaatcctttcgaaaagtacaggattgagaacggcccaatccgaaaatactcccgcaagggtaatgggcccgaaatcaagtcactgaaatattacgacaacttactcggccggtttgtcgatattacaccgagcgagtctaagaatcctgtggcactgctttccctgaacccctggagaactgacgtatattacaacaccgagacgaggaaatatgagttcttgggactcaagtacgcggatctgtgttttgaaaaaggcgggagttatggaatcagcaaggtgaagtacaataaaattcgtgaaaaggagggtataggcaaaaactctgagttcaagtttacactatacaaaaatgacctgatcctcattaaggataccgaaactaaccgccaacagatcttccggttctggtccagaacagggaaagacaatccaaagtcatttgagaagcacaaactggaacttaagccttatgagaaaaccaggttcgaaaagggagaggagttgaaagttctgggcaaggtgcccccaagtagcaaccgattacagaagaatatgcaaattgaaaacctctcgatctacaaagtccggactgatgtgctgggtaatcagcacataatcaagaacgagggggacaaacccaaacttgatttttga

SEQ ID NO: 2842 - RNA, 3420 nt, synthetic construct
  misc_feature 1..3420: note = Cas9 variant
  source 1..3420: mol_type = other RNA
atgaactactataatggcttcatcattaccgagaacgccatggctagcaagcacgaaaatctgggggcactcacatttggacttgacataggtatcgcctccgtgggctgggcggtcctgggggagaacagaattatcgatttgggagttaggtgcttcgacaaagctgaaactgccaaggagggcgaatctttaaatctggcacggcgcacggcccgactactccgtagaaggctgcggcgcagagcttggaggcttaccaaactggcacggttgctcaagcgcgagggtctgattgccgatacaaacgtgtttcagaaacccttcaatctgaaggacgctaacgagaaggggctctcattttggcagttacgagtagatgccctggacagaaaacttagtgcggaagagtgggcaagggtgatctaccatttgtgtaagcaccggggattccattggataagccgtgccgaagagaaagctgccgagggcgattccaagtctgaaggcgggaaagtcaagcagggactggcaggtactaagaaactaatgcaggagaagaattatcgcaccgctgccgaaatggtgctcacagagtttcctgaagcgcagagaaacaaacaaggcgactactcgaaggccctgtcaaggatccttctgggggatgagatgacccagttgttcaaacaccagcgggagctcggaaatccacatgcaactgaaaagctggaggctgccattttaggcaacggtgaccacaaaagcgggctgttttgggctcagaatccggccctcgcaggaaacgatcttctgaagatgttgggccactgcacattcgaaaaggccgagtatcgagttcccaaagctagttttaccgcggaacgccatgtgtggctaacgagactgaataacctcaggatcgtcgtggacggcactacccggcctctgaacgaggcagagcgccaccttgccctgttgatgccataccaacaggctggggatctcacatataagcagctgagaactgccttaaccaaagcaggatacctgcccgaatccttcaggtacacaggtctagcctatgcttctggccagaaggccgacgagaaagcaaaggaccctgaaagcgcgccactcgtaaagctgcccgcttggcatgagcttcgtaaaaccttggaaaagaaagagctggcctccgagtggcaaaagatttcaagtgatgcactcgacgggaaacctcagctgcttgatcagatcgcctgggttctgagcgtgtacaaggacgatacggaagtcgaggctgaattgtgtaagctcaatctgccaaacgccgagaaaatgatagacgcattactggatattcggtttgacaagttctctaatctatccctcaaagctctgcgacaaatcgtgccgcttatggagcagggacagagatatgatgaagccgtggcgaacattcccgagtacggccaccactcacagttgcatgaagtcggtgccggggagcacaagtatctgcctccattctacaaagaaagggacaagactggccgcatggtttttaatgatgacatggacatcccccggaaccctgtggtactcagagctctgaatcaagcaaggaaggtggtcaacgccttaatcaaagagtatggaagcccacatgaggtgcacattgaaatggctcgcgatctgagtcgaccccttgacgagcggcgtgatgttgaaaagttgcagaaagagttcagagacaggaatgaaaaggataaagccctctttgcacaggacttcaacatagtgggcgcggtcaaggggaaagagtttgagaagtaccagctgtaccgcgaacaacagggaaagtgcgcctattctatcgagccgatggatattcatcggctattcgaacagggttacgtggagatcgaccacgctctgccttattccaggagctttgatgactcgaaaaataacagggtactcgttctggccaaggaaaatcgagataaaggcaaccgcacacccttcgagtaccttgggggaaaggacaattctgagcggtggagacagtttgtggcattcgtcgaaggcaacaaatcctataggttggctaagcgttcacgcctgttacggaaggattttggtaaagacgaggccaaggggttcagagaaaggaacctcaatgacacccgatacatatgtcggtttttcaaaaactatgtggagcaatacctgcagcttcacgaggatagtgacgcaaagcgctgcgtcgtgctgagcggccagatgacttccttcttgagagccaggtggggactcgttaaagtgcggggcgattctgaccgacatcacgctctggatggggcgattgtagccgcatgtagccattcaatggtcaagagactaagtgactactcccgcaggaaggaactggaacaggtgcgtgctggatttgttgatgtggacacaggtgagatcgtcaatccagccatgttccaacaggtgcaggagcactttcctaacccctggccacacttccgggatgaagtaaaactcagactgaatgtggacgatcccgcccttttgcatagcgagatgaacaggtttggcacctattctcctgaggctctgaaggcattacgcccactcttcatctcacgagccccgcaaagacggaatagtggggcggctcacaaagacacgatttacgcccagcccgaaaggctggttgcacagggaggcgtcacccagaaggtgcctcttacaagcctgactctaaaagatctcgacaagctgatcgacccacatcgcaacgagaagttgtattccgccattcgtataagactggaacaacacggtgggaaaggcgataaggcttttcccgcatctaatcctttacggaaaccagactcggagggaaaccccaccggcccgatcgtgagaggggtcacaatggttattgataagctcagcggaatccctatccgcggcggtattgccaaaaatgactccatggtgcgagtggatgtattcactaaggcggggaaatttcatctggtcccagtgtacgttcaccacgctgtggccaaggtccttcccaacagagcagtggttgcctataaggacgaaaccgagtggacactgatagatgacggattcgatttttgcttctcaatgtaccctaatgacttgctccggatcaaactgaggaacgctagtcatctaggctattacgcctcttgtaatcgcagcaccggtgcaattaacctgtggtcccacgatagaaaccaacaggtgggcaaggacgggatgatcgagtcaattggagtaaaaactgctcttaatgtcgaaaagctcaacatcgacgtgctgggcaataggtaccccgccccacctgagaaacggcgtgatttggcgtga

SEQ ID NO: 2843 - RNA, 3423 nt, synthetic construct
  misc_feature 1..3423: note = Cas9 variant
  source 1..3423: mol_type = other RNA
atgaagaacatgaccaaagtgaatgtcggcctggacgttgggatcagctccgccggatggtctgtgattaacgctgagacaaatcagatactcgaatcaggtgtaagacttttcagtggcagcgatgcagacgagaacgtgaataggcggaaccaacgccaggggcgacgtctgtttagaaggcggaagttgcgcatccaggaagccaaaaagtacttagagaatgtcttccagctgaaagatattgaacccaaggacgagtggaacccttatgagatcagagtgagggcgctaaatgaaaaggtttccaaagaggaactctctattgctctgcttaacatcgtgaagcaccggggaatatcgtacgagctggaggatgtcactgacgaagagggcacgaatacccaatcatttcagagcggtttggattataaccgccgactcctgaaaacaaagactgtgggggaaatccagtacgacagactgcagaaatatggacaagtaaggggccagattcagaccgaggatggcctcttaatcaatattttcccaacaaagaactacgttgaagaggtggagcggatcctggaaacccagaagaaatatcatccggagatagacgatgtctttattgaaaagatcattagtttcgtgactcgtaaacgcgagtactttgtggggcccggaaatgaaaagtccagaacagactacggtatctatagggagaacggcgagacccttgataacttgttcgaaatcctgattgggaaagacaagttttaccctgaggaatatcgggccgcaggatctagctacacggcccaaatattcaatctactcaacgacctgaataaccttcgaatcccaactaccgaggatcaccatctgacaaaagctcagaaggaagagattatcactgagttgaagaatacctcccgcctctcaggcggtatgctgaaattaataagtaaggtcacaaaagcacccaaggaagagattagcgggtatagaaaagacgaaaaggataagcctgacctgcactctctcgcctactataggaaacagaagaacatgcttgagaaagagggaatccaaatcgctgatttttccgaagaactgttggacgaactagccaccatgatgacgctgaatactgagccaggcgaaattcggaagcagctcaacaaaatcacaaatcagtacgatattctgacccccgaggttatagaggtgcttgtaaagaaccatactgcgttcgtggcaacatcaaatcacaagtggcaccgctttagcctgaaattgatgaaggagttcatccctgagctcctggaaaccagtaaagagcagtctacgattttatgcgaaagaggcttcatccaaaacagggcctcctacctggacgagaatcatcactttaactatgctgagctacgtgaaaatctctacaacccagtcgtgcggaagtctacctgtgagatgctgaaagttttcacagccatccaggaaaagtatccgaacattcagaatgtgatagtcgagcttccccgagaaactaacgaggatgagcagaagagaaaaatcaagaaaattaatgacaacaatgcaaagaggaaaaaggaaatcttgaaagaggctcaagcccagtcggggctgtctgaagaggcgctcgaggaaaagctgcttaagaccaaaggactgtacttgaagctcatgctgtggtatgagcaggaaggtaaatgcgtgtactccggccaggagattcctttatcagatctgctacaaaacaaagggggatatgaagtagaccatatcataccaatcagtattagctttgacgatcgcctctgtaataaggttctggtgcggcagcagcttaactcccagaagtctaatcaaacacccttcgagtacatgactacccacacagacggccacttgagctttcatgagctgaaggaactcgtcggtaaaaacaagagattctcaaaagagaagagggaactgttactggccgagatctacagtaatgatattgaaacccgcaaacgatttatcaaccggaatcttgtggacacttcctatacggcacgtatagtcttgaacgctctccagcagtacaagaaggagaatcaactgagcatgaacgtgtctgttgtgagaggggccatgacaaacattctaaggaaaaaggtaaaactggataagacccgcgagactttccaccatcacgctatcgacgcctcactcatggcagtcattcctaatatcgaatttttcaaagagcggaaggaatggctgccaaagagtgccaacgaggaagtggttgaggtggaggtcagcgaagaggaaaccatgcccgagaaagagtttaaggtgaaaatgagacttccggaatccttcatacaggatgtacagatcttgcagaggaatagctttgctaaggaggaagtgtcgggccctcaaacacgagagcgcaacctgaaaattaagttcagccatcaggttgaccagaaaatgaatcggaaggtcgcggatgacaccatctatggaactagacaggcacaattaggcaaggataaaaaggaagagacatacgtgattgggaaaatcaaggacatatataactacgatgagtatgtgaggttcaaaaagcgttacgacaagaataaagaatcctttctcatgtaccaccacgacccccagacgttcgagaagctggaagagattcttgcccagtatccagaatacatcgaggatgagaaaggaaagaaaaagaaggtctcaccttttgctctgtatcgcgaagagaacggtcccgttaccaaatacgccaagaaaaataacggcccagtgatcaagcagttgaaatattacgacagtaagctcaatcggaagattgatatctctcataaatatagcactaagaacagacaagtggtactgcagtccctaaaaccctacaggacagacgtctaccgaaatcaggataccggggaatatacactggtgggaattgaccaaaacgatggcaagttcgttaatggtcactacgggatacctaaatcacggtatgaggaaatcaaggcaaacaacaagctcagcgagcatgacgagtttgtgttctctctgtacaaaaattccatggtcaaggtgattgatgaaaacggcgagagtatcgttgtgcgctatcttagcagatctatgccaaataggaaaaacaatgccgaaattaagccggtagagaaataccagtttgaggacggagaagtcgtgcccgtgtatggcaagtgccggaaacagatgcagactgtcttcgttaagaaggggtggaccttgctgaaaggaaacacggatatcttaggtaatacctactttgtggagaaggaatccgagaaccctaaaaagatgatagacgataaatga

SEQ ID NO: 2844 - RNA, 3423 nt, synthetic construct
  misc_feature 1..3423: note = Cas9 variant
  source 1..3423: mol_type = other RNA
atgagagagaacggcagcgacgaaaggcggcgcaatatggatgagaagatggactaccgaatcgggctggatattggaatagcctccgtgggttgggctgtcctccagaacaattctgacgatgaacccgttcgtatcgtggaccttggcgtaagaattttcgataccgcagagatccctaaaacaggggaatcactggccggaccaaggcgggcggctcgcactacgagaaggcggttgcgccgaagaaagcacaggttagaccggattaaatggctgtttgagaaccaaggcctaatcaatatagatgacttcctcaagcgttataacatggccggtctgccggatgtgtaccagcttcgctatgaggcactggacagaaaattgaccgatgaagaactcgcccaggtcctgctgcatatcgctaagcacagggggtttcggagtacacgaaaggcagaaactgccgctaaagagaatggagccgtgctcaaggcgaccgacgagaaccagaaacgcatgcaagaaaagggctacagaacagttggcgagatgatttatttagacgaagcattcaggaccgggtgcagctggtccgagaaaggatacatcctgactccccggaataaggccgaaaactatcagcatacaatgcttcgcgctatgttggtggaggaggtcaaggaaatcttttcttcgcagagaaggctgggtaatgagaaagccaccgaagaactagaagagaagtacctcgagattatgacgtcacagcgtagcttcgatctgggccctgggatgcaaccagacggaaaacccagtccttacgcaatggaaggcttttccgatcgggtgggtaagtgtactttccttggggaccagggagagctgcgaggcgctaaaggcacctatacagccgaatactttgtagcgttgcagaagataaaccacactaaactcgttaatcaggatggggagaccagaaacttcacagaagaggagaggcgcgccctgaccttactgctctttacgcaaaaggaagtgaagtatgcagctgtccggaaaaagctgggacttccagaggacattttgttctacaatctaaactataaaaaggccgctactaaagaagaacagcagaaggagaaccaaaatacagaaaaggccaaatttatcggtatgccctactatcatgattacaagaaatgcctggaggaaagagtgaagtacctcaccgagaacgaagtgagggacctgttcgatgagattggcatgatccttacttgttataaaaatgacgattctcgcacagagcgactggcaaagttggggctcgtccctatcgaaatggagggactgttagcctacaccccaacgaagttccagcacctgagcatgaaagctatgcggaacattataccgtttctagaaaagggcatgacctatgacaaagcgtgcgaggaagcaggttacgacttcaaggccgattccaaagggacaaagcagaagctcctgactggcgagaatgttaaccagaccatcaatgagattacaaaccccgtggtaaaacgttcagtgagtcaaactgtcaaggtgatcaatgctataattagaacctatggaagccctcaggccatcaacatcgaacttgcaagggagatgtctaaaacatttgaggagcgccggaagattaaaggcgacatggaaaagagacagaaaaataacgaggatgttaagaagcagatccaagagttggggaaactgtccccaaccggacaggacattctcaagtacaggctgtggcaggaacagcaaggtatatgtatgtattcaggcaaaactatcccccttgaggaactgttcaagcctgggtacgatattgaccacatcttgccatacagcatcacgtttgatgacagtttccgaaataaagtgctcgtcacatctcaggagaaccgccagaagggaaatcggaccccctatgagtacatgggcaacgatgaacagagatggaacgagtttgaaactagggtgaagaccacaattcgtgactataaaaagcaacagaaactgttaaagaaacatttctccgaggaggagcgcagcgagtttaaggaacggaatctgaccgatactaagtacataacaacggtaatctataacatgattagacagaatctagagatggccccgctcaacaggcctgagaaaaagaaacaagttcgagctgtgaatggtgccatcaccgcatacctgcggaagcgctgggggcttccccagaaaaacagagagactgacacacaccatgcgatggatgctgtcgtgattgcctgctgtaccgacggcatgatccagaagatatcgaggtatacaaaggtccgggaacgatgctactctaaaggaactgagttcgtggacgcagagaccggcgaaatctttagaccagaggattactcccgcgccgaatgggacgagattttcggggttcacatccctaagccctgggaaacgtttagggctgagttggatgtgcgtatgggagacgatccaaaaggtttcctggacacccactcagatgtagccctcgagctggactatcccgaatacatttatgagaatttacggcctatcttcgtcagtagaatgccaaaccataaggtgacaggcgcagctcacgccgatactataaggagcccgcgccattttaaagacgaagggattgttctgaccaagacagcgcttactgatttgaaactcgacaaggatggagagatcgacggctactataatccccagtccgacctgctactgtacgaggccctcaagaaacaactgcttttgtatggtaacgatgctaagaaagcattcgcccaggactttcacaagcctaaagctgatgggaccgaaggcccagtggtccgaaaggtgaagattcagaaaaagcagacgatgggagtattcgtggactctggcaatgggatcgccgagaacggaggcatggttagaatagatgtctttcgggtgaatggtaaatactacttcgtgcccgtctatacagcagacgttgtgaagaaagtgctgcctaacagggcgagcaccgcccataagccatacggggaatggaaggtaatggaggataaagactttttattctcactctatagtcgcgatctgatccacattaagtccaaaaaggacatccccattaaaatggtcaatggaggcatggaaggtatcaaggagacttacgcttattacataggcgccgatattagcgcagctaacatccaagggatcgcccacgactctcgttataagtttagaggacttggcattcagtcactggacgtgttggagaaatgtcagatcgatgttctcgggcatgtgagtgtcgtgcggagcgaaaagaggatgggattctcctga

SEQ ID NO: 2845 - RNA, 3423 nt, synthetic construct
  misc_feature 1..3423: note = Cas9 variant
  source 1..3423: mol_type = other RNA
atgaacggcctggtgctcgggcttgacatcggaattgccagcgtcggtgttggcatactggagaaaaattccgggaaaatcgtgcacgcttcttcaagaattttccccgcagccaccgcggataacaatgtagaaaggcggaagaaccgccaggctcgacgtttgaatagaaggaaaaagcatcggggagtgcgctttcaagacttattcgaggattacggcctgctaacagactttagtaaagtcagcatcaacctcaatccttatagactgagggtggatggtcttaaccagcagctgactaatgaagagttgttcattgccctcaagaacatcgttaagcggcgcgggatatcctacctggacgatgcatctgaagacggaggcacggtgtcgtcagattatggcaaagccgtcgaggagaatcgaaagctgctcgctgaaaagaccccagggcagatccaattagagagatttgaaaagtacggacagctgaggggtgacttcacagtggtagagaacggcgagaaatgccggcttattaatgtttttagcacaagtgcatataagaaggaagccgagcgtatcttgcgcaaacagcaggatttcaacaatcaaattaccgacgaatttatcgaggattacctgaagatactaacagggaaaagaaagtattaccacggaccgggcaacgaaaaatccaggaccgactacggtcggtatactacacataaggactctaaaggggagtacgtgaccctcgataacattttcggagtcctgatcggcaagtgtacgttttatcccaatgagtaccgagctagcaaggcctcctatactgcgcaggagttcaaccttctgaatgacttgaacaatctcaccgtgcctacagagactaaaaagctgtcagaagaacagaaaaagaccattatcgaatacgcaaaaagtgccaagacattaggcgctagcaccctgctcaagtatatcgccaaaatgattgatacgtctgtggaccagatacgcgggtacagagtcgatgttaacaataagccagagatccacacttttgaggtgtacaggaaaatgcaatcccttgaaacaatttcagtaggagagctgagccggaacgtgttggacgaactagcacatatcctgaccctcaatactgagcgcgaaggtatagaggaggctattaacacaaagctgaaagatagtttctctcaggaccaggtccttgaactggtgcaattcagaaagaataactccagcttgttttcgaagggctggcacaatttctctctcaaactgatgatggagttaatccccgaactgtatgagacctccgaggaacagatgacgatcctaaccaggctcgggaagcagaaatcaaaggagacaagtaaacgtactaagtacattgatgaaaaggagctgaccgaagagatctataaccctgttgtggccaaaagcgtccggcaggcgattaagataatcaatgaggccactaaaaagcacggaatttttgacaacatcgtgatcgaaatggcacgagagaacaatgaagaggatgctaaaaaggactacattaaaagacaaaaggccaaccaggacgaaaagtatgctgccatggagaaagcagccttccagtacaatggcaagaaagagcttccagataacatatttcatggtcacaaggaattggctactaaaatcaggctgtggcatcagcaaggggagaagtgcctctataccggcaagtccattcccatctctgacctgattcacaatcagtacaaatacgaaatcgatcacatacttcctctgagcttgtcattcgacgatagtctctccaacaaggtactggttttagcgacagcaaatcaggagaaaggacagcgcaccccatttcaagccctggacagcatggatgacgcttggtcttatcgggagttcaagtcatacgtgaaagaaagtaagctactcggcaacaagaaaaaggagtatctgcttactgaagaggatatcagcaaaattgaagtcaagcagaaatttatcgagagaaatttggtggacacgaggtactcctctcgcgtcgtgctgaacgccctccaggatttctataagaatcataactttgacacaaccatttcggttgtgcgagggcagttcactagccaactgcggcgtaagtggggattagagaaatccagagaaacctaccaccatcacgcagtagatgccctgatcatagctgcctcaagtcagcttaggttgtggaagaaacagaataacccgctcattgcatataaggagggtcaatttgtcgactctcagacaggcgaaatcattagcctgaccgacgatgagtacaaagagctagtgttcaaggcgccctacgaccatttcgttgatactctgtcctcaaaaacatttgaagacagcatcctcttctcttatcaggtggattccaagtttaatcgcaagataagtgacgctacgatctacgccacccggaaagcaaagctggataaagagaagaaagaatatacttacacacttgggaagattaaggacatctatagcttgggaaccaaaacaccttctaagactggcttctacaaatttctggatttatataacaaggacaaatcccagttcctcatgtttcaaaaggatagaaagacctgggacgaggtcattgagaaaatcatggaacagtacaggccattcaaggaatacgataaagccggtaagctggtggactttaaccccttcgagaaatatcgacaggagaatgggcctatacgcaagtactcaaagaaaggcaacggaccagaaattaagagtcttaaatattacgacatcctgttgggcaagcacaaaaatatcacgcccgaggggagccggaacaccgtagctctcctgtcgctaaatccgtggagaacagatgtgtattacaacatggaaactaagaagtatgagtttctgggactcaaatacgccgacctgcctttcgaagagggtggcgcatacgggatttccaccgagacatataatgaacttagggagaaggaaggaatcggcaaaaactctgagtttaagttcactttgtacaaaaatgatctgattttaataaaggacaccgagacgaactgtcagcaattctttcgtttctggagccgcacaggtaaagataatcccaagtcatttgaaaagcacaaaatcgagctcaagccatatgaaaaagctaagttcgagaaaggggaggaactggaggttcttggcaaggtccctcccagttccaaccagtttcagaagaatatgcagattgaaaacctgtctatctacaaagtgaagaccgacgtgctaggaaataaacatttcattaagaaagagggcgataagccaaagctcaaattttga

SEQ ID NO: 2846 - RNA, 3423 nt, synthetic construct
  misc_feature 1..3423: note = Cas9 variant
  source 1..3423: mol_type = other RNA
atgaacggcctggtgctcgggcttgacatcggaattgccagcgtcggtgttggcatactgaagaaagatatcggggagattatccacaccaattccagattgttctctgctgcaacagccgactcaaacattgaaaggcggggacatcgcggcggtaagcgattaactcgtaggaaaaagcacagaagtatccggctgcatgatctatttgaggacttcgggctcctgacggattttagcaaagtgtccataaatcttaacccctaccagctgcgcgtacaaggattggacaatcagctcaccaacgaagaactgttcatcgcgctgaagaatattgtgaagagaaggggcatctcttatctcgatgacgcttcggaagatggcgggacagtctcaagcgactacggaaaagccgtggaggagaaccggaagttactggcagaacagactcctggtcagattcaacttgatcgctttgagaaatatggccaggttcgaggggacttcaatgtggtcgaaaacggagagaagagaaggttgatcaatgtgtttaccacaagtgcctactccaaagaggctgaacggatactgcgtaagcagcaggagttcaacaagaaaattaccgatgaatttatcgaggactatctaactattctcacaggcaagcgcaaatactatcacggtccagggaatgaaaagtctagaaccgactacggaaggtacacgactaaaaaggatccggagggcaaatatatcaccctggacaacatcttcggcattcttatagggaagtgcacattttaccccgatgagtatcgggcaagcaaggcctcctacactgctcaagagttcaatctgttgaacgacctcaacaatctgaccgtacctacagagaccaaaaagttatcagaagaacagaaaaagacgatcattaaatatgccaagactgcgaagacactgggagcaagtaccctccttaaatacatcgccaagctgataggtgctagcgttgatcagattcatggctatcgaatcgacccaaacaaaaagcccgaaatgcacacttttgagacataccgcaaaatgcagtctttggagaccatctccgtggaggagctacctagaaaggtcctggatgaactcgcccacattctgacgcttaataccgagagggaagggatcgaggaggcaattaacgctacactgaaggacactttctcacaagatcaggtgttggaactcgtgcagttccggaaaaataacagcagtctgttttctaagggatggcattccttcagcttaaaactgatgatggagctaataccagaactctacgagacctcggaggaacaaatgacaatcctgactcgccttggcaagcagaaatctaaggagacctccaagagaacaaaatatattgacgaaaaggagttgaccgaagagatctacaatcccgtcgttgccaaatcagtgaggcaggcgatcaagattataaacgaggccactaaaaagtatggtatctttgataatattgtaatcgaaatggcacgtgagaacaatgaagaggacgctaaaaaggaatacattaagcggcagaaagccaacctggacgagaagaatgctgccatggagaaagcagccttccaatataacgggaagaaagaactccctgataatgtgtttcacggccataaggagctggctacgaagatccgactttggcaccagcagggagaaaaatgtctgtacacaggcaagaacataccaatcagtgacttgattcagaaccaatataaatacgagatcgatcacattctcccgctgagcttatccttcgacgattctctgagcaataaggtcctagtgctcgcgaccgcaaaccaggaaaaagggcagagaactccctttcaggccctggactcaatggatgacgcttggagttacagggagttcaagtcctatgttaaggatagcaaacttttgggaaataagaaaaaggagtacctgctcaccgaagaggacatctctaaaatagaagtgaagcaaaagtttattgagcgcaacctggtcgatacacggtattcaagtagagtggtattaaatgccctgcaggacttctacaaagagcatcagtttgataccactatcagcgttgtgaggggtcagttcacatcccaacttcgccgaaagtggggcttggaaaaatctcgggagacgtatcaccatcacgcagtcgacgccctcattatcgctgcctcgagccagctgcgtctatggaagaaacagaacaatcctctgatatcctacaccgaagggcaatttgtggaccaggtcactggagagatcatttcactcagtgatgacgaatataaggagctggtgttcaaagcaccatacgatcatttcgttgacacacttaagtctaagaaatttgaggatagcatcttgttctcctaccaggtggactcaaagtataacagaaaaattagcgatgcgaccatctacgctacaaggaaggccaaactggacaaggaaaataaggagtatacttacaccttaggcaaaataaaggatatttatgcactcggtacgaaatctccctccaagaccgggttttacaaattcctggacctttataacaaggataagagtcagtttctgatgttccaaaaagaccgcaagacatgggatgaagtaatcgagaaaatcattgaacagtaccggccttttaaggagtacgacgagaatggcaaagaagtcgacttcaacccatttgagaagtatagaatcgaaaatggacccattaggaagtacagcaaaaagggcaacgggccggagataaaatctttgaagtattacgataatctcctgggaaaattcgtggacatcactccttccgaatcaaagaaccccgttgccctactgagtctcaacccatggcgaaccgatgtgtattacaatacagagactagcaagtatgagtttctgggtcttaaatacgctgacttgtgcttcgaaaagggcggggcctacggaatttcggaggtcaaatataacaagatccgcgaaaaagagggcattggtaaggagtccgaatttaaattcaccctgtacaagaatgatttaatcctcataaaggacacggagacaaactgtcagcagatcttccggttttggtctagaaccgggaaagataatcctaagagcttcgaaaaacacaagattgagctgaaaccctatgaaaaggcaaggtttgagaagggcgaggaacttgaggtgctgggaaaagtaccaccctcaagtaaccaactacagaagaatatgcagatcgaaaacctctccatttacaaagtgaagactgacgttctgggcaataaacacttcatcaagaaggagggggaggaacctaaattgaagttttga

SEQ ID NO: 2847 - RNA, 3423 nt, synthetic construct
  misc_feature 1..3423: note = Cas9 variant
  source 1..3423: mol_type = other RNA
atggaggaaaacttccagtacagaatcggcctggacattgggataaccagcgtgggatgggccgtcctccaaaataactcccaggatgagcccgttaggatcacagaccttggtgtgcggatttttgatgtagctgaaaatcctaagaacggcgacgcactggccgcgccacgccgagatgctcgtactacgagaaggcggttgcgcagaaggcggcaccgcttagagcgaatcaaattcctgctacaggaaaatgggctcattgagatggactcttttatggagagatattacaagggaaacctgccggatgtgtatcagcttaggtacgaaggcctggaccggaaattgaaggatgaggaactcgcccaagtcctgatccatatagcaaaacaccgtggtttccgctcaaccagaaaggccgagacaaaggggaaagagggaggcgctgtgctgaaggcaactaccgaaaatcagaaaatcatgcaggagaagggctataggacagttggggaaatgctctacttagacgaggcctttcataccgaatgcctgtggaacgagaaaggatatgtgcttactccccggaatcgacctgatgactacaagcacacaattttgcgcagtatgctggtcgaggaagtgcatgctatcttcgccgcgcagagagcactaggtaacgagaaggccaccgaggagctcgaaaatgcttacgtagagattatgacgagccaaaggtcctttgatatgggcccagggctgcagcccgacggaaaaccttctccatatgccatggagggcttcggtgaccgggttgggaagtgtacttttgaaaaagatgagtaccgcgcacccaaggctacctatacagccgaacttttcgtggcgctgcagaaaatcaaccacactaagttgatagacgagtttggaaccggcagattctttacagaagaggagaggaaaaccattatcgatctcctgttatcgggcaaggaactgaagtacgggacgattcgtaaaaagctcaatatcgacccttcacttaaattcaacagcctgaattatagtgccaagaaagagggagaaactgaggaggaacgggtccgagatacagagaaggcaaagttcgcttccatgttttggacctacgaatattctaaatgcttgaaggacagaaacgaggaaatgactgtgggtcagaaagccgatctactggacaggatcggcgagattctcacagcttacaagaacgatgacagccgctcctcacggctggaggatcttgggctgagtagagaagagatagacggattgctcgaactgagcccagccaaataccaaagggtgtctttaaaggcaatgcgcaagatgcagccgtatctggaggacggcctaatctacgataaagcctgtgaagctgcgggttatgacttccgagcactcaatgatgggaacaagaaacatctgcttaagggcgaggagattaatgccatcgtcaacgacataaccaatcccgttgtgaaacggtccgtatcacagacgattaaggtgatcaacgctatcattcaaaagtacggaagccctcaggccgtcaatatcgaattggcacgtgagatgagtaaaaactttcaggatagaaccaatctggaaaaggagatgaaaaagaggcagcaagaaaacgagcgcgccaaacagcagattatagagctcggcaagcagaatccaacagggcaagacatcctgaaatatcggctttggaacgatcagggaggttactgcctgtattctggcaagaagattcccttggaagaactcttcgggggaggctacgacatcgatcacatcctgccttactccattacttttgacgatagctatagaaataaagtgttagttaccgctcaggaaaacaggcagaagggtaatcgaacaccatacgagtatttcggggccgacgagaaacactgggaagattacgaggcacgcgtgcggctgctagtcagagactataagaaacaacagaagctcctgaagaaaaactttactgaagaggaaaggaaggagttcaaagagcgtaaccttaatgacaccaagtacataacacgcgtggtatataacatgatccggcagaatttggaactggagccctttaaccatccggagaaaaagaagcaggtttgggcggtgaatggcgctgtcacctcgtacctcagaaaaaggtggggactgatgcaaaaggatcgatctactgaccggcaccacgccatggatgcagtggtcattgcctgttgcacggacggcatgatccataaaatttcccgctacatgcaggggagagaattagcttattcaaggaacttcaagtttcctgatgaagagacaggagagatcctgaatcgggacaacttcacccgagaacagtgggatgagaaatttggtgtgaaggttccccttccatggaatagtttcagagacgaattggatatacgcctcctgaacgaggaccctaagaatttcctactgactcacgccgatgtgcaaagggaactcgactaccccggctggatgtatggggaggaggaaagcccaatcgaggaaggacgttacattaactatatccggcccctgtttgtatccagaatgcctaatcataaagtcaccggctctgcacacgatgctacaattaggagcgcccgcgactacgagacccgaggtgtggttatcactaaggtgccacttacagacttgaaactgaacaaggataatgagatagaagggtattacgacaaagattcagacagattactctaccaggcgctggtccggcagcttctgttgcatggcaacgatggaaagaaagccttcgctgaggactttcacaagccgaaggcagatggcacggaagggcccgtggtaaggaaagtgaagattgagaaaaagcagaccagtggagttatggtccgcggcggtactgggatcgccgctaacggagaaatggtgcgtattgacgtgttcagagagaatggcaaatattactttgtccctgtttatacagccgatgtggtgcggaaggtactcccaaacagggcagcgatgaatggtaagatcgcctccgactggaaaaccatggaggataacaatttcgtctttagcctgtactctcgcgacctaatacacgtgaagcgaaagaaagctatccccacaattctgtcaagtggcgccactttcgaacaagaggaattttatgcatacttcaccggggctgacatcagcacggtttccattgccggaatctctaacgataattcgtttaaattcagaggcctcgggatacagggactggagatttttgaaaagtgtcaggtggacatccttggcaacatcagcgtcgtgcggcatgagaataggcagggtttccactga

SEQ ID NO: 2848 - RNA, 3426 nt, synthetic construct
  misc_feature 1..3426: note = Cas9 variant
  source 1..3426: mol_type = other RNA
atgtacagcatcggcctggacattgggatagcctccgtgggatattctgtcatcgagaccaactcaggtagaattgttgaactcggcgctaggatcttcgaggcacggaatagtgataacaataaggaccgccgagattttcgtgggggaagaaggcttattcggcgcagaaaaacaaggctggacgatgccaagcggtacttggacgatcagggcttcaaaaacgacaagagcttaatcaatgtgtgcccctattccctgcgcgtaaaaggtctaactgaggaactctctaagtcggaaatacgaaaggtgatcctgcacattcttaaaaagagaggggtctcatacctgagcagtgaggatttggacacgtcctctgtggataacaaagacagctttaagcaagcggttaccaaaaatctcaggcagctggatgacaagacacctggacagatccagtatgagcggctgcaagaatccggccgtgtgcgcactggcattaaccagaatgggcagtaccagctcaacgtcttcgacgtggcttcatatgccaaggagttaaaactgatccttgaaacccaacagcagtaccatcaggagatagatgaccactttttggatttctttacaaaggacggatacagagaggatgcaggtctgatttataggaaacggccatactatgacggcccggggaatgccgctcaaaacagtagctacggacgatgggcaaattatcaggtagatggcaagcccgccgaaaacatcttcgaccagctaattggtaaagattttaccgggaagatccgcgcttctaatctcggaccttccgcccaaaaattcaacctgcttaacgacctgaataacttgagaatcactacaagggaggaagagaagctcacctttgaagagaagcaggagattctggaagttttagagaatgatcggccaaaaacgttcggcccccgcaacatagcgaagatgctgaaagtggacatggacgatatcaagggctggagactcaattcaagcgacaaacctgaaattcatactatgaaggagtacaacgatatgaggcttgtcctggaagcagggggatttgacatcaaggccatagatttggaccacattgaggagatcgctagtctaatcaccctgaatacagaacgtgaggccttcgaactctctctgtccaacgagattgataataaccttaaacagttcctggtggaaaattttaacgcattgcggaagtgtaaaccaaataacagctggcattcgttctctaaggagaatctccagcgactgatcactgagttagaacacacctccgacgagcaaaacacaattctggaaagactaggtctcaaatttgatctgaggtcaaagtatagtgaccgcgatacccttcccatacacgaggtgttggaggaaatctacaaccctacggtcagcaagtccgttcggcagactttcagagtgctgaatgctctcgtgaaaaagtacggcaaagagaacattgactatgtaacaatcgaaatgccaagggataagaatgaggacgaccagaaaaagaccatccgcgaaattcagaaggtcaacaaaaatcgaaaggataaatctaaggagtactttctgaaaaagagcgggtggtcagaggaaaaattcgaggaaaaacttcggacaagtcgtagatttgcctccaagctgtattacttctatgagcaagacggattgtgcgcgtacactggccagcagatacagccggaagatctcctgaccgagagggtggaggttgaccatatcattcccttaagcgtgtctctggatgactcaatcaacaataaagtcctagtgacgagtgaagccaaccaaaagaaaggtcagcgcagcccttatgatgcatttatgtccggggacttctctaagtaccggacctacgatgagtataaggcttgggtactctcgaataagtacaagaaatataagaaagccctgcttttggaagagagaaacatttttgacccagaactggctaagaaattcaggcagcgaaatctcaacgatacacgctacgccagccggatcgttctgaatgcagtgcagtcctttttctataagactgacaccaagacaagagtcgtgaacggcgccttcactcacaccttaaggaaaaagtggaatctggctgataaagaccgtgagacacatcaccaccatgcgatagacgcaacccttgtcgccgtgactccctttgttaaggctgagcgctacgaatattacaaagattcagagggaaaggccagtatggtggacacggtaacaggcaccatcattccttactctgaatataagaaaaagaacttgtacgatcggagcaactatctcctgatgttcgggaatgagtccactatcaaccaagagaaagaagacaagtcagcagagtttattagaaatctaatcccagccaaaatataccccgaaattaagttcagccaccaggtcgataggaaatctaaccgacggctgtccgacgctaccatctatagtacacgcagctacaccgtggagaagggaagaggtaagaataaaagggaagttattgagcgggatatcataggcaagatcaaagacatttatactgccgatgggtacgcagagtacgtgaagtataaagactctctcctggtcaaggaaatcgatgagaagacatttgaaaaacttgaggcgattatcgaagagttctccgacacggtggaggtaaccgaccagcaaggaaaggtgaaaaaggtttcaaaaagtccgtttttgcagtactgtgaaaagtatgatgtccctggcgtgactaagtacagcaaaaagaacaatggtcccgtgatacgatcgctgaaatatagatacacaaagttacgctcccatattgacatctctcctaaaaacagcaagaataccgtcgctctcctgacacttgccccatggaggactgatgtttattactcacaggagaccgcaagttaccacctgttggggctcaagtatatcgacctgtccttccgtgatggcggatacggcgtgtctcggaaaagatatgaagagattaagaaaaacgaaaggatccccgaggacggggagtttaagttcagcctatacaaaaaggattatattgaaatagagtttgacaagaaaatcctgccaggactctaccagtcccgcgatgtgtcagcccgaaataagttcagcatgaaacccattgacaaggctcaatggacgagtaaagaagatgtactgatgtttggtaacgtcaaggcctctggcgtgttcgagaaaacccttaagaagaattatgttttgagaaaataccatgtggacgtcctggggaacaagttcgaggtgaaagatgaaatcttaaaggacattctcgagtga

SEQ ID NO: 2849 - RNA, 3429 nt, synthetic construct
  misc_feature 1..3429: note = Cas9 variant
  source 1..3429: mol_type = other RNA
atgtacagcgtgggcctggacatcgggattgcctcctgcggatattctataatcaacgatgtcaatggtaacattgttgagctcggcacccttctgttcaagtcaagaaatagtgacaacaatgaagagaggcggacaaaccgcgggagccgacgtttgatcaatagaaggcggactcgcttagatgacggaaagaagctgctagctgaaaaaggctttaagcaggattccaaactcaagcacgtgtgtccctacgagctgagagtaaagggtcttcatgaaaaactgacgcaaggggagatttataaggtggtcttgcacatcctcaaaaagaggggaatatcttacctggacgagtcggatgaaaactcaagcggcatcgacggcgcaagttataaagatcaggtgaatctgaacctcaatttacagaaggagctgacccctgggcagattcaacttaagcggttgaaagaaaacggacgcatcaagtccggtgttacattcgagaatggctaccagctgaacgtgttttctgtcagcgcctatgcgaatgagctaaacaaaattctcactaagcagtccgaatactactcagagatcgaccagatatggattgatcgattcaccaaaaacgggtatagaaaggaagctggactggtgtacaggaaacggccatattacgacggcccgggtaatgagaagaacaatagtatctatgggcgttgggccaactttaaggaagatggacatcccaaagagaatattttcgaccaacttatcggcctggacagcgtagattctacacaggttcgcgcatccgcctcaaccttgactgctcagaagtacaacctcctgaatgacttaaacaatctgacaatcattgaggatgacagaaaatttaccacggatgaaaaggtgagcataatcaactatctcatgactcaggacattaccaggttcggccctaaagagcttgcaaagttttaccaactggaagtcgatcagatccgggggtggcgaatagacaataagggaaacccagagattcacagtttgaaagtgtaccgcgattggaagaaaatcttcaatacatcttccatcgacctaactagcattcagacctgggtggtcgatgaactggccaacgttatcacactcaataccgagattccctcgacgctggctactcttaagataaaaatccctgacattgaccaacagatcctgaactttgtggagaacaatttctatgaattgaagaagaaaacatctaagaactcctggcattcatttagtctcaaaaccctgaatatcttaattccagagctgctaaacactagcgaagaacagaatacaatactcgaaagactgaaccttaagttcgatttgaaaaataagtacgccgagaagaaccagatccccgtaaaagagctgctcgaacaaatttataatcctaccgtgacgaagtccgtccaccagtctatcaaactgttcaacgagattatcgaaaagtacggtaaaaataacataagctatgtgaccatcgagatgccaagggacaagaatgatcaggaccagaaagatacaattaagcggatcaacaaacttaattcagagcgcaaaaacgacagtgaaaagtactttctggagagatccggctgggatactattaggttcgaaagcgcgttgaaaaagccgcgttttgcagagaaactcctgttctattacgaacaaaaggggaagtgcgcctactctggacaggacatcttagctgagtcactgctaaacgagagttgtgaagttgatcacataattcccctcagcatctcctttgacgattctattcataataaagtgctggtcaccgcctcgagcaaccaggagaagggccagcggacaccttatatggcattcatcgacggtgctaaacttgggcaatcctgggatgactttgtggcctgggtaaattcatgcggcttccaccgaaagaaagttcagaacttgctgtacgaagagaatatatttaacccagacgtgcagagaggattcgtcagtaggaatctcaacgatactcgctatgcgtctcggatcgtgctgaatgccattcagagctttttctacaagcaaaaggacttaaccaaagtcaaggtggttaacggctcctttacacataccctgaggaaaaagtgggggtcaagccttgataaaaatagagacacttatcaccaccatgcagtggatgctacgttgtgtgccgtaacacccttcatcaacattgtcaagtacgagttctttgaggaggacggaatcaagtatatggtggatctcaccactggtgaaaaagttgcttactctgactacaagaaaatgaagttctatgataaacgcgcctacgtgcctatatgggacggctttattaagcagctgaccccagcaaatctatatcccaaaatcaagttctcccaccaggtcgatagtaagtggaaccgaaaaatcagcgacgccacaatttactctacccggaagatcgtggagactaaaattaataagaaaggggtagctaaggaaacagtgaaggatatagttatcgacaaaattaaggacatctatacgccggagggatggcgtaaatttaaggaaaaacaagataagctgctcatgaagaacttcgacgagaaaacctacaacaagctgattaaaatcgcgaaggagtatcctgagaaaaaggaagtccagacttccaatggcaaggtgtcacttgtggaagtcagtccctttaaaatgtactgcgaggagcagaacgttccagcaataagaaagtacagcaaaaagggtaatgggccttatatcaggtcgttgaaattctacgataaggaactgggcaagcatattaacatcacaaaagactcctatggaaatgatattgagcgcaccatccggaacaagaaaataattttaaagaatcagaactcttggagaacagacgtgtactataatagcgtgaacaattgttacgaactcctgggcatcaaatattgccaccttaagttttacagggggaaatacggaatccccaagtcaatttatgatgagctgaagaaagaagacgagataagttccgagtctgtattcaagtttagcttgtaccgacatgatcgcgtccggttcgaaaaagacggtgagtatatcgaagccctctttggctccaagaacgagtcaaataaaaactacctggaactaagcccaattgataagaataagtggctgagtaaagagaacgtgaagttcttcggggaggttgctgcctctggaagatttatcaaaggcctcaagcccggtattaaagtgatcaagcaatccactgactatatggggcacgtctacgcaatacaccaggaaaagctgaaattcgtgcttagcgacgcctga

SEQ ID NO: 2850 - RNA, 3435 nt, synthetic construct
  misc_feature 1..3435: note = Cas9 variant
  source 1..3435: mol_type = other RNA
atgaccagcaagcaggagaaacacggcgccctgacattcgggctcgacatcggaattgcttccgtgggttgggcagtccttggcgaatctagaatagttgatctgggggtgaggtgctttgacaaggccgagactgcgaaagaaggagagtcattgaacttaacgcggcgcatggctcgactgctacgtagaaggctccggcgcagagcctggaggctgaccaaacttgcacggctgttgaaacgcgaaggcctcatcgccgatgctaatctgttcaagcataagattgagaaaaacacacccgtacctaagagtagctggcaactgcgagtggacggtctcgatagacagttaaatgcagaggaatgggccagggtcatctaccacctgtgtaaacatcgggggtttcactggatttcccgtgctgaggaaaaggccgcggagggagactctaaaggcgagggcgggaaggtgaagcagggacttgcaggtactaaaaagttgatgcaggaaaaatcgtatcgcaccgccgctgagatggttctggccgagttcccagatgcacaaagaaacaagcagggcgactactcaaaagctctaagcaggatcctcctgggggatgagcttaaggccctgtttgaacatcagcggaaattgggaaatccggtggcgacagagaagctcgaggccgcaatactgggcaacggtgacaagaaatgcgggttattctgggctcagaatcccgccctggctggaaacaagctccttgaaatgctgggccgatgtacctttgagaaaactggcggggatgacggaaagggtgaatatcgcgcccctaaagcaagtttctccgccgagagacacgtctggttgacacacctaaataacctgaggatcgtggtagatggcaccacgcggccactcaatgaagctgagcgcagagttgcgctgcccatgccttaccaacaggcaggggacctttcttataagcagctgggaggcgccttgattaaggagggttttctccagaaagacgggttcaagtttgctggcctgccataccccactaaacaagccagcgaagagaaggcaaaagatcctgaaacctccgtgttatgcaagctgccagcctggcatacactaaggaagactctcgagaaacacggactggaatcagagtggcagaaacttagtaccgacgctttggatggcaagccgcagctgctcgacaacatcgcctgggtcctgagcgtgtataaggatgacgatgaggtgaaaacagaacttgggaagctgaatttgcccaacaccgagaagatgattgacgcactcctggatatccgtttcgacaaattttctaatttatccctgaaggcgctatcaaaaatagtccctttcatggaacaaggacagcggtacgatgaggctgttgccaacattccagagtacggtcatcacagccagctccacaaggtgggcgcaggggaacataaatatctgccccctttctacaaggagcgagacaaaacgggaagaatggtatttaacgacgatatggacatcccaaggaatcccgtggtccttcgcgccttgaaccaggctcggaaggtggttaatgccctgattaaggaatatggcagtccgcacgaggtgcatatcgaaatggcaagagatctctctaggcctctggacgagcgccgagatatcgagaaattacaaaaggagttcggtgaacggaacaaaaaggacaaagaactgtttgctcaggatttcaatattgtcgggactgtgaagggcaagcagtttgagaaataccagctttatcgtgaacaacagggaaagtgtatatacccctccatggacgagaaacagggcatctgctgttatagcttgaagccactcgatctgcacagagtactatacgaggaagggtacgccgagattgaccatgcgctgccttattcgaggtctttcgatgactccaaaaacaatcgcgttctcgtgctggccaaggaaaaccgggataagggaaatagaacaccctttgagtaccttggtgacaaagacaactcagaaccatggaggcagttcgtcgcttttgtggagggcaataaggcatatcgattggccaaacgcagtcggctgttaagaaaggatttcggggacaaagaggctaaggaatttagggagcgtaacctcaatgatacccgctacatctgcaagttctttaaaaactatgtcgaacaatacctgcagcttcacgaggacagcgaggccaagcggtgtgtggttctgtccggacagatgacttctttcttgagagcaaggtggggcctcgtgaaagtacgaggtgatagcgaccggcaccatgcgctggatgccgctgtcgtggccgcatgctcacacgggatggttaagcgcctaagtgactattccagaaggaaagaactggaacaggtgcgggaaggcttcgtcgatgtggacacaggagagatagtaaatcccgctatgtttcaacaggtgcaggaacatttccctaacccatggccgcactttcgagatgaggttaagctcagactgagcattgacgatcccacccttttgcgctctgagatggaaaaattcggcacgtacacccctgagtcactggaagccttaaggccactctttgtcagtcgtgcaccccaacggagaaacagcggggccgctcacaaggacacaatctacgcgcagcctaagaggctggtggcccagggaggcgtgactcagaaagtcgcactttcctctctgaccctaaaggacctcgataaactgatcgacccacatcgcaatgagcgattgtatgctgccattagagcccggctggaacaacacggtgggaagggagataaggctttccccgcatcgaacccgttaaggaagcctgacagcgagggcaatccaacaggtcccatcgttcgcggcgtgactatggtgattgataagctctccgggatacctatccgtggaggcattgccaaaaacgactcaatggtaagagtcgatgtgtttaccaaggcgaataaattccatctggttcccgtgtacgtccaccatagtgtgcttgggctgccaaaccaggctatcgttggaggcaaggaggaatctgagtggacacagatcgacgatagctttgactggcacttctccatttatcctaatgatttgatacgggtgaccctcaaacaggaaggtaggtttgggtactatgccggatgtgaccgctcaactgcagccatccacctgtgggctcatgaccgaaaccaacaggtaggcaaggatggtctaattagaagcatcggcgtcaagacggcactgtctattgagaaattcaatgtggacgtgcttgggaaccggtaccccgccccaccggaaaagaggcgcgatctcgcgtga

SEQ ID NO: 2851 - RNA, 3435 nt, synthetic construct
  misc_feature 1..3435: note = Cas9 variant
  source 1..3435: mol_type = other RNA
atgaccagcaagcaggaaaacctgggcgccctcacattcgggcttgacatcggaattgcttccgtgggttgggcagtcctgggcgaaaatagaataatcgatttgggggttaggtgctttgacaaagccgagactgcgaaggaaggagagtctttaaacctgacgcggcgcatggctcgactactccgtagaaggctgcggcgcagagcctggaggcttaccaaactggcacggttgctcaagcgcgaaggcctgattgccgatgctaatctgttcaaacacaagatcgagaagaacacacccgtgcctaaatcaagttggcaactccgagtagacggtttagatagacagctgaatgcagaggaatgggccagggtgatttaccatctttgtaagcaccgggggtttcattggatcagccgtgctgaggaaaaagccgcggagggagactccaagggcgagggcgggaaagtcaagcagggattggcaggtactaagaaactgatgcaggaaaagtcttatcgcaccgccgctgagatggtgctagccgagttcccagatgcacaaagaaacaaacagggcgactactcgaaggctctctcaaggatactgcttggggatgaactgaaagccttgtttgaacaccagcggaagctcggaaatccggttgcgacagagaaactggaggccgcaatcttaggcaacggtgacaagaagtgcgggctgttctgggctcagaatcccgccctcgctggaaacaaacttctggaaatgttgggccgatgtacctttgagaagactggcggggatgacggaaaaggtgaatatcgcgcccctaaggccagcttcagtgcagagagacatgtgtggctaacacacctgaataacctcaggattgtcgtggatggcaccacgcggccactgaatgaagctgagcgcagagtagcgcttcccatgccttaccaacaggcaggggacctgtcctataaacagttgggaggcgccctcatcaaggagggttttctgcagaaggacgggttcaaatttgctggcttaccataccccactaagcaagcctctgaagagaaagcaaaggatcctgaaaccagcgttctgtgcaaactaccagcctggcacacactcaggaagactctggagaagcatggacttgaatccgagtggcagaaattgtcaaccgacgctctggatggcaagccgcagctcctggacaacattgcctgggtgcttagtgtctataaagatgacgatgaggtgaagacagaactggggaaattgaatctccccaacaccgagaagatgatcgacgcactgttagatatacgtttcgacaagtttagcaacctgtctctaaaagcgctctccaagattgtgcctttcatggaacaaggacagcggtacgatgaggctgtcgccaatatcccagagtacggtcaccattcacagctgcacaaagttggcgcaggggaacacaagtatcttccccctttctacaaagagcgagacaagacgggaagaatggtgtttaacgacgatatggacattccaaggaatcccgtagtgttgcgcgccctgaaccaggctcggaaagtcgtgaatgccctcatcaaggaatatggcagcccgcatgaggttcacatcgaaatggcaagagatctgagtaggcctttagacgagcgccgagatattgagaagctgcaaaaagagttcggtgaacggaacaagaaagacaaggaactttttgctcaggatttcaatatagtggggactgtcaaaggcaagcagtttgagaagtaccagttgtatcgtgaacaacagggaaaatgtatctacccctctatggacgagaagcagggcatttgctgttattccctcaaaccactggatctacatagagtgctgtacgaggaagggtacgccgagatcgaccacgcgctcccttatagcaggtcgttcgatgactctaagaacaatcgcgtactggttcttgccaaagaaaaccgggataagggaaatagaacaccctttgagtacttgggtgacaaggacaactccgaaccatggaggcagttcgtggcttttgtcgagggcaataaagcatatcgactggccaagcgctcacggttactcagaaaagatttcggggacaaggaggctaaagaatttagggagcgtaacctgaatgatacccgctacatatgcaagttctttaagaactatgtggaacaataccttcagctgcatgaggacagtgaggccaaacggtgtgtcgtgttgagcggacagatgacttccttcctcagagcaaggtggggcctggttaaggtgcgaggtgattctgaccggcaccacgcgctagatgccgctgtagtcgccgcatgcagccatgggatggtgaaacgcctgtcagactatagtagaaggaaggaactcgagcaggttcgggaaggcttcgtggatgtcgacacaggagagattgtgaaccccgctatgtttcaacaggtacaggaacacttccctaatccatggccgcattttcgagatgaggtgaaactgagactttccatcgacgatcccaccttgctgcgcagcgagatggaaaagttcggcacgtacacccctgagtctttagaagccctcaggccactgtttgtttcacgtgcaccccaacggagaaacagtggggccgctcacaaagacacaatctacgcgcagcctaagaggcttgtcgcccagggaggcgtgactcagaaggtggcactgagctccctaaccctcaaagacctggataagttgattgacccacaccgcaatgagcgactgtatgctgccatcagagcccggttagaacaacatggtgggaaaggagataaggctttccccgcatctaacccgctcaggaaacctgactcggagggcaatccaacaggtcccattgtccgcggcgttactatggtgatagataagctgagcgggatccctattcgtggaggcatcgccaagaacgactccatggtgagagtagatgtctttaccaaagcgaataagttccaccttgtgcccgtttacgtgcatcactcagtcctggggttgccaaaccaggctatcgtgggaggcaaagaggaaagtgagtggacacagattgacgattcttttgactggcatttcagcatatatcctaatgatctcatccgggttaccctgaagcaggaaggtaggtttgggtactatgccggatgtgaccgctccactgcagccattcacctatgggctcacgaccgaaaccaacaggtgggcaaagatggtctgatcagatcaattggcgtaaagacggcacttagcatcgagaagttcaatgtcgacgtgctcgggaaccggtaccccgccccaccggagaaaaggcgcgatctggcgtga

SEQ ID NO: 2852 - RNA, 3438 nt, synthetic construct
  misc_feature 1..3438: note = Cas9 variant
  source 1..3438: mol_type = other RNA
atgaagaccatcctgggcctcgaccttgggacaaacagcattggatgggccctggtgaaagagactgaaaattccaacgagaagtctgaaataatcaaattgggtgtcagagttaatcccttaacggtggatgagaagaccaacttcgaagctggcaggcctctgtcaacaaatgcagaccggactgccaaacgcagtgcgcgacgtaacctacagagatacaagctcaggcggaagaatctgattgatcttctgatcaaacaccgcttgattgacaaggataccccactcacagagatcgggaaaaacaccactcatcaaacactggagctgagagctaaggccgcaagggaacggatagagctcgaagacttagcccgcgtatttctggctatcaataaaaagcgaggatatagaagctccaggaaggtgaacaatgaggaggaaggccaggtcgtggatggtatggcagttgccaaaaagttgtacgacgagaaccttaccccggggcagtatgcttacgaactgctatctaaaggaaagaaatatgtgcccgatttctaccggtcggacctccaggccgagtttgattcaatttgggaatatcaaaagcagttctacgcggacatcctggatgacgagctttacaatgcactgaaaggccagggccagcaaaacagccgtaagcgctttttggccattaagggggtctatacggctgagaataaaggaaagagagacgaagtgaaactccagcactacaagtggaggagtgaggccatcactcagaaactgtccatagaagaggtagcatatgttttagtggaaattaacaacgatctgaataagtctagcggttacctcggcgctatctccgaccggtcaaaggagctttatttcaacaaagagaccgtcggggaaaatctgtggaagcagattcaaaagaaccctcatacaagtttgaagaatcaggtgttttaccgacaggattatctagacgagttcgaacaaatctgggagactcaggcccagtttcacccacagctgaccctcgcgctgaaagaacaaatccgcgatgtggtcattttctaccagagaaaacttaagagccagaaaggactgttgtctttttgccagttcgagtcctgggagatagaaaggaaggacgagaacggcaatgttatcctcaacaaaacaacccaactgcccaagcggcagacggtgggtcgcagagtagcccctaaatcaagcccattatttcaggagttcaagatttggcagaatatcaacaatctggagatagcaaagattagtgatgggaactctaaaaataagaaagagactgaagctctatccgacgatgagaggaagctcctgttcgaagaacttaacttgcgtggaaatctgagccaaaaagaagtgctccagatcctgggccttaaggacaaagagtacaagacaaactttcccgagggcctggaagggaaccggaccaatgccgctttgttcaacatctatcagcagattgccgagaatgaaggatacggtgattggactaagaaatcggcacaagagatcaaggaggaactcaaagccgtctttcctcagattggcatacaggctgacatcctggacttcaacgcggagttagatgggaaggaatttgagaatcaagcatcttatcagctgtggcatctactctactccgccgaagaggacgataaaattaacgaagaggaccagatcatctatggaaattcagctgtgagtctgaagaagaaactttgtgagaagttcggctttacaccagaatacgccaaatggattgcaaacgttagcttgcaggatgactatggtaatctgtccaccaaggccatgcgaaaaataatcccgtacctcattgatgggaacgactactctgaggcttgcgccctggcaggctataatcacagcaactcattaacgaaggaagagaatgataacagagagaggctgaataaacttgaattgctccccaaaaacagtctgcgcaaccctgtggtcgagaagatcctaaatcaaatggtgaacgtagttaatcaggtgattgaaacctacggaaaaccagacgaggtccggatcgaactggcgagagagctcaagaaatccgctgaggaaagggccgagatgacaaagggcataaacgaagcaactcgccgaaatgaggatatcaagaaactgattaccaagaacttcgggatccccaatcctacaaagaacgacgtggtccggtatcgtctttgggaagagttggccccactggcttacaaggatgtgtttactggaagacagattaaaaaggaggacttattcagctctaaaatcgacatagaacacattatccccaaggccctcctgtttgatgactcattcagtaataagacccttgcatttagggagacaaacctgaaaaaggctgatcgcaccgcctatggtttcattgaaagcgactacaatgcgactttggatgactatatccagcgggttgagacgctctacaacaatgccaaaggcacaatatccaaggggaaaagaaacaagctgctaatggctcaaaagaatctgccggatggattcatcgaaagggacctccgaaactctcagtacattgccaaaaaggcaaaatcgatgatcgagaaggtgtttaacgatgtaaatgtcaccagcggctccattactgaccgcctgcgggaggattgggaccttatcaacgtgatgaaagaattgaatttccctaagtataaggctctgggtttaaccgagatagaagagagatacgatattgggcaggagaaaacaaagaaagttgaagtgatcaccgactggactaagaggaacgaccatcgtcaccatgccatggatgcactcacagtcgcgtttacgaccaaatcacacgtgcagtatctgaataaccttaatactatccacagtctgaagggcgacgaggtagatctagaactctctaagctgtacggattgaaaaacacaattaccgaggtggttaataagaaacgcaagttcattcccccaatgcctaactttcgggaagaggccaaaaagcatatcgagacaatactggtcagcatcaagaataaaaacaaggtgtatactaaaaatattaacaagaccaaaaaggaatccggctaccacacgaaagagcaattaacccccagagggcagctccataaggaaacagtgtatggaaagtcaaaaaggccaatgaataagcccactaaaatcaacaagaatttcagcctggagcaggctcaacttattatcaacgtccaggaaaaagagctggttttgcgacacctcgcccagtttgacaacaatcctgcagtggctttcgataccaagacactgaagaaatgtcattacctaaagatggtgaacctgtga

SEQ ID NO: 2853 - RNA, 3441 nt, synthetic construct
  misc_feature 1..3441: note = Cas9 variant
  source 1..3441: mol_type = other RNA
atgagcggcaacacccacgggcccctgacattcggatttgacatcggtattgcctccgtgggctggtgcgtcctcggggagaatagaatagttaaccttggagtgaggtgtttcgataaggctgaaactgcaaaagagggcgaatctctgaatttggcccggcgcacggcgcgattaatgcgtagaaggctgcggcgcagagcttggaggctaaccaagctcgcccggctgcttaaacgcgagggtctgatcgcagaagcctcacgaatccatattcctagtccagtaagcccgtggagattgagggtggaggggattgaccggcgtctcacagatgacgagtgggctcgcgtcatctaccacctgtgcaagcatagaggatttcactggatatccagggcagaagaacggaaagccgaatctgatgctaaggagggcggccgagtgaagaaagggctgtcggacactcagcgcagaatgaccgagaagggatataggtcagccgcggaaatggttctcgcagagttccccgatgcccaacggaacaaacagggtgactacggcaaggctttaagccgcatcctgcttagtgatgaattggccctgctatttagaaggcagcgtgagctcgggaatcctaacgcaggaaatgaactggaggctacaattcttggcaacggtaatcggaaatccgggctgttctgggagcagaagccacccttggccggagcggacctcctgaagatgttaggccgatgtacctttgagaaaaacgagtatagagcccctaaggcatctttcactgctgaaaggcatgtgtggctgacacgcctcaataaccttcgggtcgtggtagatggcaccacgagaagcctggacgatgccgagcacaggttggttctaccactgccctacaaacaagctggggactttacttataagcagctccgcaccgccctgacaaaagcaggacttctgcctgaaggtttcaagtttgccggcttgtcctacccaactgggcgacagctcgacgatccgaaagctaaggaccccgagtcagagaagctggtgcggttacctgcgtggcaggaactgcgtaaaaccctaaaggataaaaatctcgagacagaatgggagggaatggcaggcgccgctaccggtgggaacccagaactgcttgacgagatcgccagagtcttgagtgtgttcaaggatggcgacgaggtgacggcagaactgtggaaactccccctgcctggaggcaaggccatgattgatgctcttagcgagatctcttttgacaagttccacgccctgtccttgaaagcactcaggaagatagtcccacatatggaatcagggctgcgctatgatgaggcgtgcgctgttgccggataccaccatagccaattacacgcagccggtgctggcgagcacaaattcctgcccccgttttacagtcggagagacaaggatgggaggatggtgttcaatgaggaactagacgtacctcgaaaccccgtggtcctccgcgccctgaaccaggcacggaaagtgcttaatgctttggttagaacttatggatctccaacagccgtgcatattgaaatggcgagggacctgtcccgtcctctcgatgagcgcaacaaggtcaagaaagcccaggacgaataccgggagagaaatgagaaggataaagctgcatttgccgctgaatatggcatcgcccccaagagcagggagttcgaaaaatttcagctgtaccgagagcaacagggtaagtgtgcatattcgttaaagtctctggaccttcaccgggtgttgcatgatattgggtacgcggaagtagaccacgccctcccatattcccgctcatacgatgacagtaaaaacaataaggttctggctctaaccgaggagaacagaaataaaggcaacaggactgcctacgaatatctgaccagcttccccggaggcgagaatggggaacggtggcgaaacttttccgtggcagtcgagacaaataaggcttacagactcgccaaacgcacgaggctgcttcgtaaggatttctctggacgggcagccgaagagtttagagagaggaacttgaatgacacccgctatatctgccgattctttaaaaacacagtggaaagattcctgaagttagatgctaaggtcggtgcgggcgacactgccgagatcagcgcaaaacggtgtgtggttctctcagggcagaccacagcttttctgagggcccgctggggacttctgaaggtgcgtggcaatagtgatagacatcacgccttggacgctgcagtagtcgccgcgtgctcccacggtatggtgaaacggctcggggactacagcaggactaaggaactggctaaagttcatgatggcttccctgacccagagaccggagagattatagatccggtgatgttccaacagctacacgcccattttcccgacccttggccacacttccgcgcagaactggaggcccgactcaacgtcgatgacacagctgatctgagagcacggatggaactttttggcacctatgcccccgaggcgttggaaactctgaggcctttattcgtgtctcgcgctccacagagaaggaactcaggggccgcacacaaggacacgatctacgcccagcccgagcggctcaaggagcaaggaggcgtaacacagaaagtgccgctgaccagtcttactctgaaggatctagacaaactcattgatcctcatcgtaatgaaaagctgtatgctgccatccgcgcacgattggaggctcacggtgggaaagccgacaaggcgtttccagccggaaaccccctgagaaagcctgatagggaaggcaatcccaccggtccagttgtccggacagtgaccatggtgatagacaaattaagcggcattcctgtccgcgggggaatcgcaaagaacgacactatgctcagagttgatatcttcaggcataaaaaggacggcaaatttcacctggtgcccgtgtacgtataccatgctgtcgccaaggagttcccaaatcgggctattgtgcaggcaaaggatgaagacgagtggacacttatcgatgacaaatttgatttctgtttttccgcccacccgaacgacctgttgaagattacgcagaaatctggggagaccatattcggatattaccgaggctgccactcgggtactgccgctatcaatattgcgctccatgatagatatgcatacgccgaaaagacaaccagcctggctttttccaaaaagaaccctgggaaacccatcccaaatgacaagctaggactgatcgagggcattggtgttaagatggccgcaaacatggaaaaattccacgtggatacacttggcaatatatatcccgcccctccagagcaacgcagggggctcgcttga

SEQ ID NO: 2854 - RNA, 3441 nt, synthetic construct
  misc_feature 1..3441: note = Cas9 variant
  source 1..3441: mol_type = other RNA
atggcctacagactgggcctcgacatcgggattaccagcgtgggatgggctgtcgttgcacttgagaaggatgaatccggtctgaaacccgtgaggatacaggacttgggcgtacggatcttcgataaggccgaggactctaaaacaggggcgtcattagctctgcctcgccgagaagcccgtagtgcaagaaggcggactcgcagaaggcggcaccgcctatggcgagtgaagagactcctggagcaacatgggattcttagcatggaacagatcgaggccctgtatgctcagaggacgtcctctccagatgtctacgcattgcgggtggccggcctcgaccgttgcctgattgctgaggaaatcgcccgcgttctgatacacatcgcgcatagaaggggttttcagtcgaaccggaaatcagagattaaggatagcgacgcagggaagctcttaaaagccgtgcaagaaaatgagaacctgatgcagagtaagggatatcgaaccgtcgctgagatgcttgtgtccgaagccacaaaaactgatgcagagggcaagttggtacacggcaaaaagcatgggtacgtttctaatgtgcgcaacaaggctggagaatatagacacaccgtcagcaggcaggccatcgtggacgaggtgcggaaaattttcgcggcccagcgcgcactgggtaatgatgtcatgtccgaggaactagaggactcatacctcaagatcctgtgtagtcaaagaaactttgatgacggcccgggaggagacagcccctatggccacggttctgtttcccctgatggggtgaggcagtcaatatacgaacgtatggtaggaagctgcacattcgagaccggcgaaaaacgggctccacgaagttcttactcctttgagagattccagcttctgactaaggtggtcaatttgaggatttatcgccagcaagaagacggcgggcggtacccctgtgagctcacacagaccgagagagccagggtgatcgattgcgcttatgaacagacgaaaattacttacggaaagctgcgcaaattactggacatgaaggataccgagagctttgccggtctcacatatggccttaaccgatcgcggaataagactgaagacaccgttttcgtggagatgaaattttaccatgaagtccgtaaggcactgcaaagagccggggtgttcatccaggatttgtctatcgagacactagaccagattggatggatactgtccgtatggaaatcagatgacaacaggcgcaagaaactcagtaccctgggccttagcgataatgttatcgaggaactgttgcctctcaacggttccaagtttgggcacctgtctttaaaggctattcggaaaatcctgccattcctagaggacggctatagctacgacgtggcgtgtgaactcgcaggataccagtttcaaggcaagacggagtatgtcaaacagagactgcttccccctttgggggagggagaagtgactaatccagtcgtgaggcgagccctgtcacaggctataaaggttgtgaacgccgtaattcgcaaacatggtagtccggagtccatccacatcgaactcgcacgggagctgagcaagaatcttgatgaaagaaggaagattgagaaagcccagaaggagaaccagaaaaacaatgaacaaatcaaggacgagattcgtgaaatactgggctctgctcacgtcacagggcgcgatatcgtgaaatacaagttgttcaagcagcagcaagagttctgcatgtattcaggagaaaaactcgacgttacccggctgtttgagcccggctacgccgaggtggatcatattatcccttatggtatcagtttcgacgatagctacgacaacaaggtcttagtgaaaactgaacagaatagacagaaggggaacaggacaccactggagtatctacgagataaacccgaacagaaggcaaaatttattgcgctcgtagagtccatacctctgtctcaaaagaagaaaaatcaccttttgatggacaagcgggctatcgatctggaacaggagggcttccgcgagagaaacctctcggacaccaggtacattacgcgggccctgatgaatcatatccaggcatggttactgtttgatgaaaccgccagcacacgatccaaaagagtggtttgtgtcaacggagctgtgactgcctacatgcgcgcaaggtggggccttaccaaggaccgtgacgctggggataaacaccatgccgcggacgccgtggtcgttgcttgcattggagattcattgatccaacgggtgacaaagtatgacaagttcaaaagaaatgcactcgccgataggaaccgctacgtgcagcaggtaagtaagtctgagggtataactcagtatgtcgacaaagaaaccggcgaggtgtttacatgggagagcttcgatgaacgaaagtttctgccaaatgagcccctagaaccgtggcctttctttagagacgagctgctcgctcggctgtccgatgacccctccaaaaacatcagggccattgggcttttgacctacagcgaaactgagcaaatcgatccaattttcgtttctcgcatgcctacgcgtaaggtgacaggagcagcgcacaaggagaccatcagatcaccccggatagtcaaagtggacgataataagggcactgaaattcaggttgtggtaagtaaagtcgccctgaccgagttaaagctcacaaaagacggtgaaatcaaggactattttaggccagaggatgacccccgcctgtacaacacccttcgagaaagactggtgcagttcgggggcgatgctaaggccgcattcaaagagcctgtgtataagattagcaaagacggatctgtccggactccagttaggaaggtgaaaatccaggagaagttgacactcggcgtaccggtgcacgggggacgcggcatagctgaaaatggtgggatggtcagaatcgatgtgtttgccaaaggaggcaagtactacttcgttcccatttatgtggcagacgtcctgaagagggagctacctaaccggctggccacggctcataaaccatactccgaatggcgtgtggttgatgactcatatcaatttaagttcagtctctaccccaacgatgcggtgatgatcaaacctagccgcgaggtcgacattacctataaggatcgaaaagaaccagtaggttgtagaatcatgtactttgtgtcggccaatatagcatccgcttctattagcctgaggactcacgacaactcaggcgagcttgaggggttgggaatccagggcctggaagttttcgagaagtatgtggtcgggcccttaggagacacacatccggtgtacaaggaacggcgcatgccttttagagtagagaggaaaatgaattga

SEQ ID NO: 2855 - RNA, 3441 nt, synthetic construct
  misc_feature 1..3441: note = Cas9 variant
  source 1..3441: mol_type = other RNA
atggcctacagactgggcctcgacatcgggattaccagcgtgggatgggctgtcgttgcacttgagaaggatgaatccggtctgaaacccgtgaggatacaggacttgggcgtacggatcttcgataaggccgaggactctaaaacaggggcgtcattagctctgcctcgccgagaagcccgtagtgcaagaaggcggactcgcagaaggcggcaccgcctatggcgagtgaagagactcctggagcaacatgggattcttagcatggaacagatcgaggccctgtatgctcagaggacgtcctctccagatgtctacgcattgcgggtggccggcctcgaccgttgcctgattgctgaggaaatcgcccgcgttctgatacacatcgcgcatagaaggggttttcagtcgaaccggaaatcagagattaaggatagcgacgcagggaagctcttaaaagccgtgcaagaaaatgagaacctgatgcagagtaagggatatcgaaccgtcgctgagatgcttgtgtccgaagccacaaaaactgatgcagagggcaagttggtacacggcaaaaagcatgggtacgtttctaatgtgcgcaacaaggctggagaatatagacacaccgtcagcaggcaggccatcgtggacgaggtgcggaaaattttcgcggcccagcgcgcactgggtaatgatgtcatgtccgaggaactagaggactcatacctcaagatcctgtgtagtcaaagaaactttgatgacggcccgggaggagacagcccctatggccacggttctgtttcccctgatggggtgaggcagtcaatatacgaacgtatggtaggaagctgcacattcgagaccggcgaaaaacgggctccacgaagttcttactcctttgagagattccagcttctgactaaggtggtcaatttgaggatttatcgccagcaagaagacggcgggcggtacccctgtgagctcacacagaccgagagagccagggtgatcgattgcgcttatgaacagacgaaaattacttacggaaagctgcgcaaattactggacatgaaggataccgagagctttgccggtctcacatatggccttaaccgatcgcggaataagactgaagacaccgttttcgtggagatgaaattttaccatgaagtccgtaaggcactgcaaagagccggggtgttcatccaggatttgtctatcgagacactagaccagattggatggatactgtccgtatggaaatcagatgacaacaggcgcaagaaactcagtaccctgggccttagcgataatgttatcgaggaactgttgcctctcaacggttccaagtttgggcacctgtctttaaaggctattcggaaaatcctgccattcctagaggacggctatagctacgacgtggcgtgtgaactcgcaggataccagtttcaaggcaagacggagtatgtcaaacagagactgcttccccctttgggggagggagaagtgactaatccagtcgtgaggcgagccctgtcacaggctataaaggttgtgaacgccgtaattcgcaaacatggtagtccggagtccatccacatcgaactcgcacgggagctgagcaagaatcttgatgaaagaaggaagattgagaaagcccagaaggagaaccagaaaaacaatgaacaaatcaaggacgagattcgtgaaatactgggctctgctcacgtcacagggcgcgatatcgtgaaatacaagttgttcaagcagcagcaagagttctgcatgtattcaggagaaaaactcgacgttacccggctgtttgagcccggctacgccgaggtggatcatattatcccttatggtatcagtttcgacgatagctacgacaacaaggtcttagtgaaaactgaacagaatagacagaaggggaacaggacaccactggagtatctacgagataaacccgaacagaaggcaaaatttattgcgctcgtagagtccatacctctgtctcaaaagaagaaaaatcaccttttgatggacaagcgggctatcgatctggaacaggagggcttccgcgagagaaacctctcggacaccaggtacattacgcgggccctgatgaatcatatccaggcatggttactgtttgatgaaaccgccagcacacgatccaaaagagtggtttgtgtcaacggagctgtgactgcctacatgcgcgcaaggtggggccttaccaaggaccgtaatgctggggacaaacaccatgccgcggatgccgtggtcgttgcttgcattggagactcattgatccaacgggtgacaaagtatgataagttcaaaagaaacgcactcgccgacaggaatcgctacgtgcagcaggtaagtaagtctgagggtataactcagtatgtcgataaagaaaccggcgaggtgtttacatgggagagcttcgacgaacgaaagtttctgccaaacgagcccctagaaccgtggcctttctttagagatgagctgctcgctcggctgtccgacgatccctccaaaaatatcagggccattgggcttttgacctacagcgaaactgagcaaatcgacccaattttcgtttctcgcatgcctacgcgtaaggtgacaggagcagcgcacaaggagaccatcagatcaccccggatagtcaaagtggatgacaacaagggcactgaaattcaggttgtggtaagtaaagtcgccctgaccgagttaaagctcacaaaagatggtgaaatcaaggactattttaggccagaggacgatccccgcctgtacaatacccttcgagaaagactggtgcagttcgggggcgacgctaaggccgcattcaaagagcctgtgtataagattagcaaagatggatctgtccggactccagttaggaaggtgaaaatccaggagaagttgacactcggcgtaccggtgcacgggggacgcggcatagctgaaaacggtgggatggtcagaatcgacgtgtttgccaaagatggaaagtactacttcgttcccatttatgtggcagacgtcctgaagagggagctacctaaccggctggccacggctcataaaccatactccgaatggcgtgtggttgatgactcatatcaatttaagttcagtctctaccccaatgatgcggtgatgatcaaacctagccgcgaggtcgacattacctataaggatcgaaaagaaccagtaggcctgagacttatgtactttgccggtgcagacatctcgggcgctactttgacactgaggacccacgacaactccggggagttaaagggactcggcatacaggggctggaggtgttcgaaaagtatgttgtgggaccccttggcgatacacatccggtctacaaagagcggcgcatgccttttagagtggaaaggaagatgaattga

SEQ ID NO: 2856 - RNA, 3447 nt, synthetic construct
  misc_feature 1..3447: note = Cas9 variant
  source 1..3447: mol_type = other RNA
atgaccaagctgaaccagccctacggcatcgggctcgacattggaagcaattccataggtttcgccgtggtcgatgctaactctcaccttctgagattgaaaggcgagacagcaatcggggccaggttatttcgggaaggacaatcagcggctgaccgccgaggcagtcgtactacgagaaggcggctgagccgcaccagatggaggctatccttcctccgggatttcttcgcccctcatattacaaagatcgacccagactttttcctgcgccagaaatattctgagatttcgccgaaggataaagatcgatttaagtacgaaaagagacttttcaatgacaggactgatgcagagttttatgaagcctacccctcaatgtatcatctgcggttgcgtctcatgaccgacgctagccaggcagatcctcgcgagatcttcctggccatacaccacatcctgaaaagtagaggtcattttctcacaccaggggctgccaaggacttcaacaccgataaagttgacttagaggacatttttcccgcgctgactgaagcatacgcccaggtgtatcctgatcttgagttgacattcgacctggctaaggccgatgacttcaaagcaaagctactcgatgaacaagctaccccatccgacacgcagaaggccctggtaaatcttctgttgtctagcgatggagagaaagagatcgtgaagaaaaggaagcaggtcctcactgaatttgcgaaagccattaccggcctgaagacaaaattcaacttagcactgggcactgaggtggacgaagctgatgcctccaattggcagttttcaatggggcaactcgacgataagtggagtaacatcgagaccagcatgacagaccagggaaccgaaatattcgagcagattcaggagctttaccgggctcgactgttgaatggtatcgttcccgccggcatgtctctatcccaagcaaaggtggccgactacgggcagcacaacgaagatctggagctctttaaaacgtatctgaagaaacttaatgaccacgaactggctaagactattcgcgtcatctacgatagatatatcaacggagacgatgcgaaacctttcttgagggaggactttgtgaaggcactcacaaaggaagtaaccgcccatccaaatgaggtttcagagcagctgttaaaccggatgggccaagctaatttcatgctgaaacagcgcactaaggccaacggtgcaattccggtgcagctacagcaaagagaactcgatcagataatcgccaaccagagcaaatactatgactggctggctaagcccaatcctgtcgagaaacacagggccagtaagccataccagcttgatgaattgctgacatttcgtattccctattacgtggggcctctcatcaccccaaaggagcaagcaaaatctggagaaaacgtgttcgcgtggatggtccggaaggacccctccggcaatataacgccgtacaactttgatgagaaagttgaccgagaggctagcgccaatgtgttcattcagagaatgaagaccacagatacttatctgatcggcgaagacgtacttcctaaacagtcgctgttgtaccagaagtatgaggtgctcaacgaactgaataacgtcagggtgaataacgaggcattagggaccgaccaaaagcagcgcctgatccgggaggtttttgaaagacattcttccgtgacaattaaacaggtcgccgataatctagtggctcacggagacttcgcccagaggcccgagatccgcggtctcgcagatgaaaagcgattcctgtcaagtcttagcacttaccaccaattgaaagagattctgcatggcgctatagacgattccaccaagctccacgacatcgaaaacattatcacatggtctaccgtatttgaggatgccgcgatcttcaaaactaagctggccgagattgactggttagatgctgcaacgataaagaagctgagcaatatccggtatcgtgggtggggacagttttcaagaaaacttttggacggcctcaaactgggtaacgggcagacagttattcaagaactaatgctgagtaatcataacctcatgcagatcctgaccgatgagactcttaagaccacaatggccgaattgaaccaggacaaactgaaggctgatgacattgaggacgtgatcaatgatgcctacacctccccaagcaacaaaaaggcattaaggcaggtcctccgcgtggtcgaagacataaagcacgcggccaatggccaagatccttcttggctgtatatcgagactgctgacggacccggcacagccgggaaacggacgcagtcaagacagaagcagattcaaaccgtgtacgcaaacgctgcccaggagcttatcgatagtgcagttaggggagaactggaggacaaaattgccgataaggctagcttcactgaccgattggtgctctactttatgcagggtggccgcgatatctatacaggggcgccactgaatatagaccagctatcccattacgatattgaccacatcctgccccaatctctcattaaagacgattcgctggacaaccgggtacttgtcaatgccaccatcaacagagaaaagaataacgtgttcacaagcactttgtttgcatccaagatggctgccacctggaggaaatggcacgaggccggactgatatcaggccgtaagttacgcaatctcatgctgcggcctgatgaaatcgacaaattcgctcatggttttgttgcaagacagcttgtggagacgaggcagattatcaagctgaccgagcaaattgccgcggctcagtatccaaacacaaaaatcatagccgtcaaggcagggctaagtcaccagctccgagaggaactggatttcccgaagaatcgggacgtgaaccattaccaccacgcctttgatgctttcttggcagcccgcattggcacttatctgttaaaaagatacgcgaagctcgctccctttttcacctatggagaatttgccaaagtagacgtgaagaaatttagggagttcaattttatcggcgcactgaagcatgccaaaaagaacatcgttgctaaggatacaggggagattgtctgggacaaagaacgggatatccaggagcttgaccgaatttacaacttcaagagaatgctgataactcacgaagtgtactttgagaccgccgatttgttcaaacaaacgatctatgcagctaaggactctaaagaacgcggaggtagcaagcagctcattcctaagaaaaggggctacccaacacaggtgtatgggggaatccatggcaagattcgtctgacctggcggtggctaaaactgcttagaaggaagaaaatgtccatcgagctctcagagctgcagttgctgaagtga

SEQ ID NO: 2857 - RNA, 3450 nt, synthetic construct
  misc_feature 1..3450: note = Cas9 variant
  source 1..3450: mol_type = other RNA
atggagagataccacatcggcctggacattgggaccagctccataggatgggccgtgatcggtgatgacttcaagattaaaaggaagaaaggcaagaacctcatcggggtccggctttttaaagaaggagatacagctgcagagcgccgaggcttccgtactcaaagaaggcggctgaatcgcagaaagtggaggttgaagttactggaagagatttttgacccctatatggccgaagttgataaatacttctttgcgcggctaaaggagtctaacctctcacctaaagacagtaataagaaatatctgggtagccttctgttcccagatatctccgactctaacttttacgataagtatccgacgatataccatttgcgccgagacctcatggagaaggataaaaagttcgacctgagagaaatctatctggctattcaccatatcgtgaaatacagggggaattttctcgagaaggtacccgccaaaaactacaaaaattcgggagcatcaattggcttcttactggaagaggtgaacgatctttatggcaatatcatagggaacgaggacgtcgccattttggacaatgataaatttgaagacgtggagaagatcattctgaacgatgaaatccggaatatcgacaagcaaaagaacgttggacgtctactcgtgaaggataaaaaggagaaaaatattgtcaccgctttcagcaaggcaatatttggttacaagttcaacctggaagaccttctgttgatcgagagtgatgagaaaaacaagctcacattcaatgacgaaaacattgatgacatctttaatgagctgtcccactctttaaacgataatcagatggacctgctcactaaaacccgcgaaatatatttcaagtttaaacttaacatgattgtgcctacaggctacaccatcagcgagtccatgatcgaaaagtatgagatgcataaggcccacctgaaaatgtacaaggagttcattaatactttgaacgctaaagacagaaagatccttaaaaatgcctattcagattacattaacaatgaaaaggcgaaggcagccaacgctcaggagaatttttacaaaacagtaaagaaaaccataaaggaaaacgacagtgatacggccaaaaagatcattgggctgatcgacgagggaaatttcatgccaaaacagaggactggcgaaaacggtgttatcccccaccaactccatcagattgagctggatcggataatcgagaaccaggcaaagtattacccttggcttgctgaagagaatccagtggaaaagaaccgaaaatttgccaagtataaactggacgagttggtcaccttccgcgtgccctactatgtggggcctctcattgataagacagagagcaataaaaacgaaaaggagactaagtttgcgtggatggtcagaaaagccaagggaaccatcacaccatggaatttcgaaaacctggttgacaggaccgagtctgcaaatcggtttattaaacgcatgacgtccaaggatacttacatcataggcgaagacgtgttaccggcttcaagcctgctatatgagaaatacaaggtactcaacgagctgaataacatcaaggtgaataaaaagaaacttgatgtcgaacagaagcaacacgtgtacttggacctgttcacaaccaggaaaaacgttactaaggatgacctcgccacaagtctgaattgcgacgtggagtctattaccggccttacggataacaagaaatttaattccagcctgtcgtcttatatcgacttgaaggctattctcgggaacatcgtcgatgactactccaaaaacgaagatctggagaagataattgaatattcaaccatcttcgaggacggaaatatttacaaagagaagttaagtgaaatcagctggctgacagatgagcagatagaaaaactatccaacatccatttcaagggttggggcagactctctaagaaactgcttactcagattaccaatgagaacggggaacgtatcattgacacattgtggaatactagcaacaattttatccaggtgatatcagatgagagtattcaagccaagctggcagagatcaacggagaatatgccaataaatacaacctcgaggacatcctggatgaggcttataccagcccccagaataagaaagcgattcggcaggtaatgaaggttgtggaagacatcgagaaggcaatgaaatgtgaacctacatccattgccatagagttcacccgagaaaagagaaaatctaagttaactaacacgaggtacaaaaagatctcagagacatacgaaaagattaccgatgagctgatcagtgagtatgaacttggcaaattgcaaagcgagctcgactccaaggtcaataacatgcgcgaccggtactatctgtactttatgcagctaggtagagatatgtatactggggagaaaatgaatattgacgaactgcaccagaagtacgatatcgaccacatactcccacagtctttcatcaaagatgactcgctgaacaacagggtgcttaccagcaagtccgtcaatattaaggaaaaatcagataagacagctgccgacttgtatgcagccaaaatgggcgatttttggcgcaagctgcgaaaacaaggattaatgaccgagcagaagtacaagaacctcctgactcggacagacagtatcaataaatacacgaagcagtctttcattaaacgtcagcttgtggagaccagccaagttgtgaagctggctgccaacatcttgcaggataaatatagaaatactaagataattgaaatcagggcacgcctcaactccgacctgcggaaaaagtacgagctaatcaagaatagagaagtaaacgactatcatcacgcgattgatggctacctgacaacctttgtcgggcagtatctctacaaagtgtatcccaagctgaggtcatacttcgtttacgacgattttaaaaagctagacagcaattatttgaaacatatggataagttcaactttatatggaagctggaggacaaaaaggctgaagatgtgtacgacaaagtcaatgatgagttcgtgttaaacgtacctgagatgaaggaatatatccgaaaaatttacaattataagtacatgctcgtgtctaaggaggttacaactaaaaacggagccttttatgaccagaccaagtacaatgcaaaaacgatcaacctgattccaatcaagaaagataagcccaccaatatatacggtggctataaggggaaagtctccagttacatgatgcttgtgaagatccagaaaaagaaagaagtgatttataagttcgtcggagttccgcgcctgtggacagacgagctagatcggctcatcgacactgacgagaaaaaggccctgttgaagaaatga

SEQ ID NO: 2858 - RNA, 3459 nt, synthetic construct
  misc_feature 1..3459: note = Cas9 variant
  source 1..3459: mol_type = other RNA
atgaacgccgagcacggcaaggaagggctgctcatcatggaggaaaatttccagtacagaattggacttgacataggtatcaccagcgtgggctgggctgtcctgcaaaacaattcccaggatgagcccgttaggattacagacttgggggtgcggatctttgatgtagcagaaaaccctaaaaatggagacgccttagcggctccacgccgagatgcccgtactacgagaaggcggctgcgcagaaggcggcatcgcctagagcgaattaagttcctcctgcaggagaacggccttatcgaaatggactcttttatggagagatattacaaaggtaatctgccggatgtgtatcagttgaggtacgaagggctcgaccggaagctgaaagatgaggagctggcacaagtcctcatacacatcgccaagcatcgtggattccgctcaaccagaaaggctgaaacaaaagagaaggaaggcggcgcagtgttaaaagccactaccgagaaccagaagattatgcaggaaaaagggtataggacagttggagagatgctgtaccttgacgaggcttttcacaccgaatgcttgtggaatgagaagggttatgtgctgactccccggaaccgacctgatgactacaagcatacaatcctacgcagtatgctcgtcgaagaggtgcacgccattttcgcggcacagagagcccacggcaatcaaaaagctaccgaagggctggaggaggcctacgtagaaatcatgacgagccagaggtcctttgatatgggaccaggccttcagcccgacggtaagccttctccatatgcaatggaggggttcggagaccgggttggcaaatgtacttttgaaaaggatgagtaccgcgctcccaaagccacctatacagcggaactgttcgtggccttgcagaagataaaccatactaaactcattgacgagtttggcaccgggagattcttttcggaggaagagaggaagacaatcattggactgttactgtcaagcaaggaactcaaatacggtaccatccgtaagaaacttaatatcgatcctagtctgaagttcaactccttgaattattctgctaaaaaggagggcgagacggaagaggaacgggtcctagacactgagaaggctaaattcgccagcatgttttggacatacgaatattccaagtgcctgaaagatcgaaccgaggagatgccagtgggggaaaaggctgacctcttcgatagaattggagagatactgactgcctacaaaaacgacgattcaaggagtagccgccttaaggaactgggcttgtctggtgaggaaatcgacgggctcctggatttatccccggcaaagtaccaacgggtgtcactgaaagccatgagaaagatgcagccctatctagaggacggcctcatttacgacaaagcatgtgaggcggcaggatatgattttagggccctgaacgacggcaataagaaacaccttttgaagggggaagagatcaacgctatagtcaatgatattacaaaccctgttgtgaagcgcagcgtaagtcagaccatcaaagtgatcaatgccattatccaaaagtacggatctccacaggcagtcaacattgaactggcccgagagatgtccaaaaatttccaggaccggacgaacctcgaaaaggagatgaaaaagcgtcagcaagagaatgaaagagctaaacagcagataatcgagctgggtaagcagaaccccaccggccaagatattcttaagtataggctgtggaatgaccaagggggatactgcttgtatagcggcaaaaagatccctctcgaggaactgtttgatggtgggtacgacatcgatcatattttaccatactcgataacattcgacgattcttatcgcaacaaagtgctggttactgcccaggagaatcggcagaagggcaacagaaccccctacgaatattttggagcagacgagaaaaggtgggaagattacgaggcgtccgtgcgactactcgtccgcgactataagaagcagcagaaactgcttaagaaaaatttcacagaagaggagcggaaggaatttaaagagagaaacttgaacgacactaagtacatcaccagggtggtatataatatgattcgtcagaacctggaactcgagccgttcaatcaccctgaaaagaaaaagcaggtttgggctgtgaacggcgccgtcacatcatacctgcgcaaacggtgggggttaatgcaaaaggatagaagtaccgacaggcaccatgcaatggatgccgtggtcatcgcttgttgcactgacggaatgattcacaaaatcagccgatacatgcagggtcgggagctggcctattcccgcaattttaagttccccgatgaggaaacgggcgagatacttaacagagacaattttacaagggaacagtgggatgagaagttcggggtgaaagttccattgccttggaactctttccgggacgaactcgatatccgactgctaaatgaggaccccaagaactttctgctcacccatgcagatgtgcaaagagagctggactacccaggatggatgtatggcgaagaggaaagccccattgaggagggtcgctacatcaattatattaggcctcttttcgtatcacgtatgccaaaccacaaagtcactgggagtgctcatgatgccaccatccggtccgcgagagactacgaaacaaggggcgtggttataaccaaggtgccgttgactgacctgaaattaaataaggataacgagattgaaggatattacgacaaagatagcgaccgcctcctgtaccaggcccttgtccgacagctgttgctccacggcaatgatgggaagaaggcttttgcagaggacttccacaaacccaaggccgatggaacagaaggccctgtggtaagaaaagtgaagatcgagaaaaagcagacgtctggtgttatggtccggggagggaccggcattgctgccaacggtgagatggtgaggatcgacgtgtttcgcgaaaacggcaagtattacttcgtcccagtttatactgcagatgtggtgcgtaaagtactgcccaatagagcggccacacataccaagccttactcagagtggcgggtcatggacgatgctaactttgtgttcagtctatatagcagggacctgatacacgttaaatccaagaaagacatcaagacaaatctcgtgaacgggggactgcttttgcaaaaggaaatttttgcctactatactggcgcagatatcgctaccgcctctattgcagggttcgccaatgactcgaactttaaattccgcggactgggcatccagagcttagagatatttgaaaagtgtcaggtcgatattctcggtaatatctccgtggttcgacatgagaacagacaggagttccactga

SEQ ID NO: 2859 - RNA, 3462 nt, synthetic construct
  misc_feature 1..3462: note = Cas9 variant
  source 1..3462: mol_type = other RNA
atgaagaacatcctgggcctcgaccttgggctgagctccattggatggtctgtgataagagagaatagcgaagaacaggaattggtcgccatgggtagtagggttgtgagcttaaccgctgcagagctgtcctctttcacacaaggcaacggggtatcgatcaattcacagcggactcagaaacgcacgcagcgaaagggatacgatcgttatcaactaagaaggaccctcctgcggaacaaacttgacacactgggcatgttgcccgatgacagcctcagttacctgcctaagctgcagctctggggtttacgcgccaaagcggtgactcagagaattgaactgaatgagcttgggagggtcttgctgcacctaaaccagaagcggggatataagtccatcaaatctgattttagcggcgacaagaaaattaccgattacgtgaagacagttaaaacccgctatgacgagctcaaggaaatgcgactgactatcggcgagcttttctttagaaggctgacagaaaatgctttctttcggtgcaaggagcaagtgtacccacgtcaggcctatgtcgaggagttcgattgtataatgaactgccagcgcaaattttacccggacatcttgaccgatgagacgattagatgtatcagggacgaaattatctactatcagcggcccctcaagtcctgcaaatacctggtgtcacgatgtgagttcgaaaagcgcttttatttaaatgcagccgggaaaaagactgaggctggacctaaagtaagtccaagaaccagccccctgttccaagtttgcaggctctgggagtctataaacaatattgtggtcaaggatcggcgcaacgaaatcgtgtttatttccgcagagcagagagccgctcttttcgactttctgaatacacatgaaaagttgaaaggttcagacctactgaagctcctgggccttagcaaaacttacgggtataggctgggagagcagttcaagaccggcatccaaggtaacaaaacacgtgtggaaatcgagcgggccttggggaattaccctgataagaagcgactcctgcagttcaacttacaggaggaaagttcttccatggtcaacaccgagacgggagaaattataccaatgatcagcctgtcgtttgagcaggaacccctatatagactctggcacgttctgtactctattgacgatagggagcaacttcagtccgtgttgcgccagaaattcggcatcgacgatgacgaggtactggaacggctctcagcgatagatctggtgaaggcaggctttgggaataaaagtagcaaggccattagaaggatccttcctttcctgcagttgggaatgaactacgctgaggcctgtgaagcagctggttataatcattccaacaattacactaaagccgagaacgaggcgcgcgccctcctggaccgattaccagcaatcaagaagaatgaactgcggcaaccggtcgtggagaaaattctaaaccagatggttaatgtggtcaacgctctcatggaaaagtatggccgttttgatgagatcagagtggaactggccagggagcttaaacagtctaaggaggaacgcagcaatacatacaaatcaattaacaagaatcagcgggagaacgaacaaatagctaagagaatcgtagagtatggggttcccaccaggagtcgcattcagaaatacaagatgtgggaagagtccaaacactgctgtatctattgcggacagcctgtggacgtcggcgatttcttgcgaggttttgacgtggaggtcgaacatatcattccaaagagcctgtacttcgacgattcttttgccaataaagtgtgttcatgccggagttgcaacaaggagaaaaacaatagaactgcatacgactatatgaagtcaaagggggaaaaagccctctccgattacgttgagagggtgaacacaatgtataccaataaccagatatctaagacgaaatggcaaaatctgttaacccccgtagacaagatctcgattgatttcatcgaccgtcagctgcgcgaaagccagtacattgctcggaaagcgaaggagatccttacatccatatgttataacgtcactgcaacctcaggcagtgtgacatcttttcttagacacgtttggggatgggatactgtgctccacgacctgaatttcgataggtacaagaaagtcggcctaaccgaggtgatcgaagtaaaccatcgagggagcgtgattcggcgcgagcaaatcaaggactggtccaaaagatttgatcacaggcatcacgccattgacgctctgacaatcgcctgcaccaagcaggcatatatacagcggctcaataacctgcgagccgaagagggacctgatttcaataaaatgtcacttgagagatacattcagagccaaccacacttctctgttgctcaggtccgcgaagccgtggacaggatcttggtgtcctttcgtgcaggtaagcgggcggtcactcccggcaagagatacattaggaaaaaccgcaagcgaatcagtgttcagagcgtgctgataccgagaggggctttatctgaggaatccgtgtatggagtaatccatgtctgggagaaagacgaacagggccacgtgattcaaaagcagcgggccgttatgaaataccctatcacgtcaattaatagggagatgctcgataaggagaaggtggtcgacaaacgcatccatcgtatactgagtggtagacttgcacagtataacgataatcccaaggaagccttcgctaaaccagtgtacattgacaaggagtgtcggatccctatcaggacagttcgctgctttgccaaacccgcaattaacaccctggtgccattgaagaaagatgacaaggggaaccccgtagcttgggtcaatcctggcaacaatcaccatgtggccatctatcgagatgaagacggaaagtacaaagagagaactgtgaccttctgggaagcggtcgatcggtgtagggttggcattccagccatagtgacacagccggacaccatctgggataacattctccaacgcaatgacatcagcgagaacgtactggagtcgctacccgatgtgaagtggcagtttgtcctgtccctccagcaaaatgaaatgttcattctggggatgaacgaggaagactatagatacgctatggaccagcaggattacgcacttttgaataaatatctgtacagggtgcagaagttatctaaaagcgactattcatttcggtaccacactgagacaagtgttgaagataagtatgacggaaagcctaacctcaaactgtccatgcaaatgggtaagttgaaacgtgtgtctatcaagagcctgctaggcctcaatccacacaaagtccatatatccgtgctgggggagatcaaggagatttcatga

SEQ ID NO: 2860 - RNA, 3474 nt, synthetic construct
  misc_feature 1..3474: note = Cas9 variant
  source 1..3474: mol_type = other RNA
atgaactactataatggcttcatcattaccgagaacgccatgacaagcaagcaggaaaaacacggggctctgacttttggactcgacataggtatcgcatccgtgggctgggccgtccttggggagtctagaattgttgatctgggagtgaggtgcttcgacaaggcggaaacggctaaagagggcgaatcattgaatttaacccggcgcatggcccgactgctacgtagaaggctccggcgcagagcatggaggctgacaaaacttgcccggctgttgaaacgcgagggtctcatcgctgatgcaaacctgtttaagcataagattgagaaaaatactcccgtacctaagagtagctggcaactgcgagtggacgggctcgatagacagttaaacgccgaagagtgggctagggtcatctaccacctgtgtaaacatcggggattccactggatatcccgtgccgaagagaaggcggcagagggcgactctaaaggcgaagggggaaaggtgaagcagggtcttgccggcaccaaaaagttgatgcaggagaaatcgtatcgcacagctgccgaaatggttctggcagagtttccagatgctcaaagaaataagcagggggactactcaaaagccctaagcaggatcctcctgggagatgaacttaaggcgctgttcgagcatcagcggaaattgggcaacccggtggccaccgagaagctcgaagcagctattctgggtaatggggacaagaaatgcggattattttgggcccagaaccccgctctggccggcaataagctccttgagatgctgggccgatgtactttcgaaaagacagggggagatgacggtaagggcgagtatcgcgcacctaaagccagtttttccgctgaaagacacgtctggttgacccacctaaacaatctgaggatcgtggtagatgggacgactcggccactcaacgaggcggagcgcagagttgcactgcccatgccttaccaacaggccggagacctttcttataagcagctgggcggtgctttgattaaggaagggttcctccagaaagacggctttaagttcgccggactgccataccccaccaaacaagcaagcgaggaaaaggccaaagatcctgagacatccgtgttatgcaagctgccagcttggcatactctaaggaagaccctcgaaaaacacggcctggagtcagagtggcagaaacttagtacagacgccttggatgggaagccgcagctgctcgacaatatcgcatgggtcctgagcgtgtacaaggatgacgatgaagtgaaaaccgagcttggaaagctgaacttgcccaacacggaaaagatgatagacgcgctcctggatattcgttttgacaaattctctaatttatccctgaaggctctatcaaaaatcgtccctttcatggagcaaggtcagcggtatgatgaggccgttgcaaacattccagaatacggccatcacagccagctccacaaggtgggggccggagagcataaatatctgccccctttttacaaggaacgagacaaaactggcagaatggtattcaatgacgatatggacatcccaaggaaccccgtggtccttcgcgctttgaatcaggcccggaaggtggttaacgcactgatcaaggagtatggtagtccgcacgaagtgcatattgagatggctagagatctctctaggcctctggacgagcgccgagatatagaaaaattacaaaaggagtttggggaacggaataaaaaggacaaagagctgttcgcccaggattttaacatcgtcggcacagtgaagggaaagcagttcgaaaaataccagctttatcgtgagcaacagggcaagtgtatttacccctccatggacgagaaacaggggatctgctgttacagcttgaagccactcgatctgcacagagtactatatgaagagggatacgcggaaatagaccatgccctgccttattcgaggtcttttgatgactccaaaaataaccgcgttctcgtgctggctaaggagaatcgggataagggtaacagaacccccttcgaataccttggcgacaaagacaattcagagccatggaggcagtttgtcgcattcgtggaggggaacaaggcctatcgattggctaaacgcagtcggctgttaagaaaggattttggagacaaagaagccaaggagttcagggaacgtaatctcaacgatactcgctacatttgcaagtttttcaaaaactatgtcgagcaatacctgcagcttcacgaggacagcgaagcaaagcggtgtgtggttctgtccggccagatgacatctttcttgagagcgaggtggggtctcgtgaaagtacgaggggatagcgaccggcaccatgccctggatgctgccgtcgtggcagcttgctcacacggcatggttaagcgcctaagtgactactccagaaggaaagagctggaacaggtgcgggagggatttgtcgatgtggacaccggcgaaatcgtaaatcccgccatgttccaacaggtgcaggagcattttcctaacccatggccgcacttccgagatgaggttaagctcagactgagcatcgacgatcccacgcttttgcgctctgaaatggagaaatttgggacctatacacctgaatcactggaggcattaaggccactcttcgtcagtcgtgctccccaacggagaaatagcggagccgcgcacaaggacactatttacgcccagcctaagaggctggtggcacagggcggtgtgacccagaaagtcgctctttcctctctgacactaaaggacctcgataaactgatcgacccacatcgcaacgaacgattgtatgccgccattagagctcggctggagcaacacgggggaaagggcgataaagcatttcccgcctcgaatccgttaaggaagcctgacagcgagggtaacccaactggccccatagttcgcggggtgaccatggtgatcgataagctctccggcattcctatccgtggagggatcgcgaaaaatgactcaatggtaagagtcgatgtgttcacaaaggctaacaaatttcatctggttcccgtgtacgtccaccatagtgtgcttggactgccaaatcaggccattgttggcggtaaggaagagtctgaatggacccagatagacgatagcttcgactggcacttttccatctatcctaacgatttgattcgggtgactctcaaacaggaggggaggttcggatactatgcaggctgtgaccgctcaacggccgctatccacctgtgggcacatgaccgaaatcaacaggtaggtaaggatggcctaattagaagcatcggggtcaagacagccctgtctatagaaaaatttaacgtggacgtgcttggaaatcggtaccccgcgccaccggagaagaggcgcgatctcgcttga

SEQ ID NO: 2861 - RNA, 3486 nt, synthetic construct
  misc_feature 1..3486: note = Cas9 variant
  source 1..3486: mol_type = other RNA
atgaagaaaatcctgggcctcgaccttgggagcgcctccattggatgggctctggtggaggaaaccgagcagatgcaatacaacatagtctctttgggttcaagaatcattccctataatggcacagaagggcaggagttcgaaaagggaactggcgagagtaggaacagcttacggacgaaagcacgcaccgcccgaaagggttacgatcgttatcagctgagaaggaaaaatctagagaagatcctcctgcagaacgggatgtaccctaatgaacaagttcgggcgcttcagaagctggagttgtggaaactccgcgctgacgccccaaacgtgcagatttccctgccggaactgggaagactcttattttggctgaatcagaagaggggctataaatcttcgcggtcagatgcaaaccttgacaagaaagatacagagtacgtagccactgtcaagagccgccaccaaaagatcaaagacgctggccagaccgtggggcagtatttctacggacagatattggagaatgaataccatcgaatcaaggagcaagtgtttcccagagaagcatatattgaggagttcgatgccatcgttgctaggcagaaagaatactatcctacaattctgaagcaggagctaatcgacaaaatacggaacgaagtgatttactttcaacgtggtctcaagagtcagaaaggcctggtctccgtgtgcgagttcgaagggcgcgagtttaatggacacttcggcggtccaaaggtagcccccaagtctagccctatctttcagcttgggaaaatttgggaaaacatcaataacatcaagattgcggatatagagctgaccgcagagcagaaattggttttctttaattatctcaactgtcatgaaagaatcactgaggccaagattagggaactgttaaaactgtccaaggactcacggctcaacggacaacttaagaatggcctgacaggcaacaaaacctacagtcagatcgctagctgcttcgggaataagataggagagtatgaacgattgtttaaattcgagctagaggtgattgaatctgagaagctggaatacacgtaccacccaaaatcccatatccccgtcggtgagaagcgcagaaagtatatctcagagaacgtggaaaaagagccttactataggctctggcacactatttacagcatcaaggataaagacgaatgtcgggccgcactgattaagaatttcggcatagaggaagagatcgctgagaaacttgccagtctggatttttctgccgggggattcggcaacaagtgcgcgaaggtgattcgcaaaatcttgccatatctcatggaaggtgacaagtacaatgtcgcaatggactatgctgggtacaaccactcctttagccagaccaaagatgagaatctgcagagagttttactggactcgatcaaccatctaccgaaaaattctctcaggcaacccattgtggaaaagatactgaaccagatgatcaatcttgtaaacgaggtgattaagcagtggggccgtcctgatgaaatccgggtcgagttggcccgaaaactgaagcagtccaagacagagagaaatgacgatgacaacttcatgaggaaacgcgaacgggagaacgaaattatcaaggctgatctcgccaaatacggactgaaggcaactagaaataacgtgataaaatggaggctttatcacgagatcgacgataaggacaagaaactgaatgcccgctgtatttactgcggccaaccaatctcattgaccgaagctattctcgggaacaatgttgatgtggagcatatcatacccaaggacaaactgtttgacgatagtcagagcaacaagacattagcgcaccgatcctgtaattctggaaaaggtaacaagaccgcatatgacttcatgaaggataaacctcagtttgaggaatacgtcgcccgggtggaggaactgtataagaaacacctaattagcctcacgaagaaacgtaagttcctgatgtcagaggacaagatcccaagtgattttattgacagacagcttagggagtcccaatacatcgctcgcaaaagccgggaaatattgcagactgtatgcagaaatgtttggtctacagatggcggggtgaccgcccatctgaggaagctctggggatgggacgatgtcactatgaacctgcagatgcccaaatataagggcatcggtatgacagagattgtggaatgggagtcaaatcacgggaaaaaccaacatacccaggaagtcatcaaggactggagtaaacgagatgaccaccgccatcacgcaattgatgccttagtggttgcttgtacgcggcagggctacatccagagaataaataccctgaacagctccgagacaaaggacgagatgcacaggaaggtggccggatctcttgtagagttcaatcaaaaacatactttgctcaacaagtacctgattaccgaaaaaccgtttacaacttcggaagtcgaggacgtggttagcaagatcctagtgtccttcaaagcaggcaagaaggcggctacccctgggaaacgtaaggtcggaaaacgcggtaacaaacaggtggtacaggatggcatcattatccccagaggggccctgcacgcagactcagtgagtggatctattaaacagtatgatccaacaggcaattttgaaaaccataatgttataaagtacaaggtcggtgtggggaaaggctatctcttcgacggaaaggatgacaaaaagaaaatcgataagaccattgactgcatcgtggataagaaaattcgggacctgatcaagcaaagggccgaggagagcaactactcccttaaaaagatgttcgaaactcctatattgtttaatcagcgagctgtcttctcagttcggtgtaaaacgggcaacaaggccgtggtgcccatccgcaatgggtatgtagtcccagataacaatcaccacacagcaatttacaagtatgacggaggcctgaaagagcagtgcgtgagcttaatgcaggctatcgaaagaaagaggtacaacctccccattatcataaagaatcctaaggagatttacgataaaatcaccgaaatcgccaacattaatcaactgctttttgactctctgccaaagttggactgggagttcgttactaccctccagaaaaacgatatgtttatactgggtatggactattccgcgacagaggaagccctagctgatgggaattaccggctgctcagtgagtatctgtacaaggtgcagaacatcagcgacggaatttatcgactttgccatcacaccatcactaagttcgatttgtctaaagcaaacaagccggacaaaagattttacaatattcaatccctgaaggcctggaacacattaaatccccagaaagtcaagatcaacatactcggccagatcgaacgccagtga

SEQ ID NO: 2862 - RNA, 3501 nt, synthetic construct
  misc_feature 1..3501: note = Cas9 variant
  source 1..3501: mol_type = other RNA
atgcacgtggagatcgacttcccccattttagcagaggcgattcccacctggccatgaacaagaatgaaattctcagggggtcttcagtcctttaccggctgggattggacttaggtagtaacagcctgggctggttcgttacccatctagagaaacgcggggatcgacacgaacctgtggctctcggaccaggcggtgtacgtatatttccggacgggagagatccccagtccggaacatctaatgcagtggacaggcggatggcccgcggcgcgagaaagaggcgggatcgcttcgtcgagcgaagaaaagaactgatcgctgcccttattaagtataacctgttgcctgacgatgcaagggagcggcgtgccctcgaggtgctggacccatacgctctgcgcaaaactgcactcacggataccttacccgcccatcacgttggcagagctctgtttcaccttaatcaaaggcgggggttccagtcgaaccgaaagacagactcaaagcagagcgaagatggagccatcaaacaggcggcaagtcgcttggccactgacaagggtaatgagaccctgggcgtgtttttcgctgacatgcatctaagaaaatcctatgaagataggcaaacagccattcgggcagagctcgtccgcctggggaaggaccaccttaccggaaacgctaggaaaaagatctgggccaaggtgagaaaacgtctgtttggcgatgaggtattgcctcgggcggacgccccacatggtgttcgagcaagagctactataacagggaccaaggcctcttacgattattaccccacgagggacatgctccgcgatgagttcaatgctatctgggccggacagagcgcacaccacgccactattaccgacgaggctcggacagaaatcgagcatattatcttttatcagagacctctgaaaccagcgatagtgggcaagtgcactttagatccggcaaccaggcccttcaaagaagaccctgagggctaccgcgccccatggtcccaccccctggctcagcgatttcggattctctcagaggcccgtaaccttgaaatcagagatacagggaagggaagtaggcgcctgaccaaagagcaaagcgacttggtcgtggcagccctactggctaatcgggaagtgaagttcgacaagctcagaacgctgcttaaactgcctgccgaggcaaggttcaacttggaatctgatcgacgcgcggctctcgacggtgatcagactgccgcacggctgtccgacaagaaaggctttaataaggcctggagagggttcccacccgagaggcagattgctatcgtcgcccgtttagaggaaacagaggatgaaaacgagctgatcgcatggctagaaaaagagtgtgctctcgacggagccgcggccgctcgcgttgcaaataccactctgccggatggccattgccggcttggtttgagagccattaagaagatagtgcctatcatgcaggacgggctggatgaggacggcgtagctggagccggctaccacattgcagcgaaaagggccgggtatgatcatgctaagctccccacaggagaacaactgggtcgacttccatactatggccagtggctgcaggacgccgtggtcgggtcaggagatgcacgggaccaaaaagagaagcagtacggccagtttcctaaccccaccgtgcacatcggtttggggcagctccgcagagttgtgaacgacctgatagataaatatggcccacccacggaaattagcatcgagttcaccagggctttaaagctgagtgagcaacagaaggccgaacggcagcgagagcagagacgcaatcaagacaaaaacaaggcaagggccgaagaactagctaaatttggacgtcctgcgaatccacggaacctcctgaagatgagactttgggaagagttggcccacgatccgctggacaggaaatgtgtctacacaggcgagcagatctctattgaacgcctcctgtccgatgaggtggacatcgatcatattttacccgtagcaatgactctggacgatagccctgctaataagataatctgcatgcgatatgccaacagacacaagcggaaacagaccccatcggaagccttcgggtcttcccccacacttcagggacataggtacaattgggacgatattgctgcacgcgccactggtttgcctcgtaacaagagatggcggtttgacgcgaatgctagggaggagttcgataaacgcggcgggtttctcgcccgacaactgaacgagaccggatggctagcaagactggccaagcagtacctcggcgctgttacagacccaaatcagatctgggtggtccccggtcggctgacctcaatgcttagggggaaatggggcttgaacggactgttaccgagtgacaattatgcaggcgtgcaggataaggccgaggagttcctcgcgagcactgacgatatggaattttccggggtcaaaaaccgcgctgaccacagacaccatgccatcgatggactggtgacggcacttacagacaggtctctgttgtggaagatggccaatgcttacgatgaagaacacgaaaagttcgttattgagcctccatggcccaccatgcgggacgatctcaaagccgcactggagaagatggtggtaagccataaacctgaccacggcatagaaggtaagctacatgaggattcagcttatgggtttgtcaaacccctggacgccactggactcaaggaagaggaggcgggcaacctggtgtaccgtaaggccatcgaaagtcttaacgagaatgaagttgaccgcattcgagatatccaattgagaaccattgtgagggaccacgtcaacgtggagaaaacaaagggtgtagcactggctgatgccttacggcagctccaggctccatccgacgattatcctcaattcaaacacggcctgcgccatgtgagaatccttaagaaagaaaagggggactacctggttcccatagcaaatagggccagcggagtcgcctataaggcttactctgcgggcgagaacttctgtgtggaggtgtttgaaaccgcagggggaaaatgggatggcgaggccgtccggcgattcgacgctaataagaaaaacgccggtccaaagatcgcacacgccccgcagtggagagatgctaatgaaggggcgaagctagttatgcgcattcataaaggagacctcatcaggctggatcacgagggccgggcccgtattatggtggtgcatagattggacgcagctgccggtaggtttaagctggcagatcacaacgaaactggcaatttagacaaacgccacgccacaaacaatgacatcgatcctttccggtggctcatggcttcatacaacacgctgaagaaacttgccgcggtacccgtccgagtggacgagctggggagagtttggagggtgatgccaaattga

SEQ ID NO: 2863 - RNA, 3507 nt, synthetic construct
  misc_feature 1..3507: note = Cas9 variant
  source 1..3507: mol_type = other RNA
atggccagacccgctttcagggcacctcggcgcgagcacgtgaacggctggaccccagacccgcatcgaatcagcaagccctttttcattctggtctcctggcacctcctttctcgtgttgtgatagattcaagtagcgggtgctttcctggaacatccagagaccatactgataaattcgccgaatgggagtgtgcggtacagccatacaggctgtcttttgacttgggtaccaattcgatcggctgggggttactgaacctagatcggcaaggaaagccccgcgaaattagagctctcggctcaaggatcttcagcgacggtcgggatcctcaggacaaagccagtctggcagtggcccgccgacttgctagacagatgaggcggcgtcgcgatagatatctgacgaggcggacacgattgatgggggcactcgtccgctttggactgatgccagccgaccccgctgccagaaagaggctggaggtggcggttgatccttacctcgcacgggaacgcgccactagagagaggttagagccattcgaaattggccgtgctctgtttcaccttaatcagcggcgaggctataaaccggtgagaaccgccacaaagcccgacgaggaagcagggaaggtcaaagaggctgtggagaggttggaagccgcgatcgccgcagctggagcccctaccctgggtgcttggttcgcctggcgcaagactcggggcgagacactaagagcaaggctcgccgggaaaggaaaggaagctgcgtacccattttatcccgcacgccgaatgctggaggccgagttcgataccctttgggctgagcaagcccggcatcaccctgacctgttgacggcagaggcccgtgaaatactcagacacaggatctttcatcagcgcccactgaaacccccgcctgtaggccggtgcactttataccccgacgatggtagagctccaagggccctgccttccgcacagcgactccgccttttccaggagctggcgtctttgcgggttattcacctagacctgagcgaaagacccctcaccccagctgagagggatcgtatcgtggccttcgtccaagggcggccccctaaggcaggacgcaagccaggcaaagtgcagaagtccgtgccgtttgaaaaactgagaggccttctggagttgccccctgggacaggattctcactcgagagtgacaagaggccagaactgttaggtgatgagactggcgcccgaattgctcccgcctttgggcctggatggaccgcactgccactagaagaacaggacgctctcgtcgaactgcttttgacagaggccgagcccgaacgggcgatcgccgctctgaccgcacgctgggccctcgatgaggctacggccgcaaaactggcgggcgccactcttccggacttccatggtagatatgggaggcgggctgttgccgaactgttgcctgtgctcgagcgagagacaagaggcgatccagacggacgcgtaaggcccatacgtctggatgaagcagtgaagttactgcggggcgggaaagaccacagcgacttttctagagagggagctctactcgatgccctgccttactacggtgcagtccttgaaaggcacgtggccttcggcaccgggaaccccgctgacccagaggaaaagcgcgttggacgagtggcgaatcctactgtccatattgccttgaaccagctgagacacctcgtgaatgcaatcctggctcggcatggcaggcccgaggagattgtaatcgaattagcccgcgatctgaagcgttccgccgaggacagacggagggaagataaacgccaagctgacaaccagaagcgaaatgaggaaagaaaacggcttatcttgtcactcggtgagaggccaacaccgcgcaacctgctaaagctgagactctgggaggaacaggggcctgttgagaataggcggtgtccctatagcggcgaaaccattagtatgcgtatgctgctttctgagcaagtggatatagaccacatcttgccattttccgtcagcctggatgactcggcagccaacaaagtggtctgcttacgcgaagcgaatcgaattaagagaaacaggtctccctgggaggctttcggacatgattccgagcggtgggccggcatcctcgcacgcgccgaagctctgcctaagaataaaagatggaggtttgcaccagacgcccttgagaagctggaaggggagggaggtttgcgggcgcgacacctcaacgatacgagacacctgtcacgcctagctgtggagtacctgaggtgtgtttgccccaaagtgcgggtaagtcctggccgtctcaccgccctgcttagaaggcgctgggggatagacgcaattttggccgaagctgacggaccgccacccgaggtccctgccgaaacactggatccaagccccgcagagaagaaccgggctgaccatcgacaccatgccttagatgcggtggttatcggctgtatcgacagatccatggtgcagagggtccagctcgccgcagcttctgccgaacgcgaggctgcagcccgggaggataatattagacgtgtgctggaaggtttcaaagaggaaccttgggacgggtttagggccgagcttgaacggcgcgctcgaactatcgtagtgagccacagaccggagcacggcattggaggcgcgctgcataaggagaccgcatatgggcccgttgatccacctgaagagggattcaacctagtcgtgaggaagcccatagacggcctctcaaaagatgaaatcaatagtgtgcgggacccacgcctgagaagggccttgattgatcgactggctatccggcgtagagacgccaacgatcctgcaacagccttagctaaggcggccgaggacctcgcagctcagcccgcctcccgcggtatcaggcgggtcagagttctgaaaaaggaaagcaatccaattcgcgtggagcacgggggaaacccgtctggccctaggtcaggtggcccctttcataaacttctgttggcaggggaggtgcaccatgtagacgtcgccctccgagctgatggacggagatgggtgggccactgggttactctgttcgaagcccacgggggaaggggcgcggacggtgcagccgctccaccccgcctaggggatggagagcgtttcctgatgcggcttcataagggcgactgcctcaagctggaacacaaaggtagagtgagggtcatgcaagtggttaagttggagcctagtagcaattccgtggtagtcgtggagccacatcaggtgaaaaccgatcgctctaagcacgtcaaaatatcgtgtgaccagctgcgagcccggggcgctagaagggttacagtggatcccttagggcgcgtaagagtgcatgcacctggagcccgggtcggcatcgggggagacgctggcaggaccgccatggaaccggcagaggatattagctga

SEQ ID NO: 2864 - RNA, 3513 nt, synthetic construct
  misc_feature 1..3513: note = Cas9 variant
  source 1..3513: mol_type = other RNA
atgagcaagtacaacgtgggcctggacatcgggattgcctccgtcggatggtctatagttgatgctgacaaaaagaaaatcattgatctcggttcaagaatcttcagtagcggcaatgcagccgcgaaccaggagaggcgggggtttcgcggaacccgacgtcttattagaaggcggaagaatcgcctgacagacgtgatcaacttctttggcgaaaagaagttcatagatactaaggtagtggacaaaaatggtcacgtccattataagttttccgtgaacaatacggagtctccctacgaattgagagttaaagggttatcggagatcctgaccaagcaagagctagtgattgctctctatcacatcgtcaaacataggggaatttcatacgatctgggcgaccttgaagatgacggcacaagcggggtgactgattataagaccagtatcaacataaatcggcagctgttgaacgagaagacagtaggacagattcagctcgaacgcctgaatgagttcggtaaagttcgaggccaagtggaagagaacgagaatgtcaccctgctcaacgtgtttccttccgccgcatacgtgaaggaagccactcagatcttaacaaaacagagagagttctatccagaaattaccgacgattttatcgctaagttcatgctgtttatcacgaggaaacgggactacttcgtcgggccgggaaatgagaagtctcgtactgactacggcatttataaaaaggatggtcgcacccttgacaacttgtttgatgaactgatagggatcgacaagattaacggagagaaaagagcaagcgcctcctcactaacagctcagatctacaatatgctcaacgatctgaataaccttactgttcccaataccgaggacggcaggctgacaatacaaaccaagaaagaaattttggaggccgcgaagacgactaacggcctcttcgggatcgcacagatctgcaaaattatcggatgtaagaaggatgacattaaaggtttccggatagataagagtgagaaaaagatcatgcacacactgagcggctatcgaaaatttcgcaaggaattagccgacgtgaatattgaagctaacgatctgaatatcaacctcgtaaataagatcgccgacattcttaccctgaacactgagaaagcagagataagaaagcagttggacaaatctaatatggatatctccaacgaaatgaaggagattgtgatcaataaaaacaaggagttcctagtcgacgggagggctacatggcattcatttagctacaagaccctgaacctcctgattcctgaacttctgaatacgccagaggaacagatgaccatcttgacacggctcggactggtgaaacccaacaataagaaatatgagggcttaaagaacatacctgcccgcagaatcactgaagagatttacaatccagttgtggcgagggccacccgtgaagcagtcaacgtgttcaatgctatcactaaaaaggtaggtcgggataacattaaagacgttatcatagagctgccccgagaggataatgaagtggacattaagaaggggatcgtcaaaagacaaaagcagaacgaggtggaaaaagagactgccgatgctctagtcaagcagcacatgaccattagtgactctgccctcatcgcacaatataggaaaatacgcggcctgtcccagaaggtgcggtactggtaccagcaggatacaatctgcccttattgtggaaagaaaattgaagccgttcaacttatcaataacaatgacagctttgaggtggatcacattgtaccaatctcggtctctttcgacgattcccagaacaataaggtgttggttcattcacagtgcaaccaggctaaagagaagcaaaccccgctgggctggctcaacaatgggggaggttttggccagagtaaagcggactacatagcaagagtcaagagcaacaagaattatgccaaaaacaagattgacaatctgcttaacgaaactgatctgaatgacatcgctacgcagagggggttcatccagcgcaacttgaatgatacacgatacgcctcccggattgtgctcaacgagttttattctttctttcgtagcaataacctgtcaaccaaagtgaaggtagtgagaggaaaatggacttcacaaatgaggaagaagtggaatggcgttggtgggttatccaaaacccgcgacacataccaccatcacgcaatcgatgcctgtattatagcttgcttccccctgctaaaggcctttgacaaagcaatcaagctcattgatgtcgacggcgaaaccggagagatcctgcaggataaaaaggcgattaaacttgctcaggaagccgagatcgtggagaagataagcgtgatcaagaacaaaaagttcgaaaatatggtcaacgagatttataacttccctttgtttaaacaggttgaactggcaaatgacatcactaacctcgagaatccagtgaagttctctcaccatgtggataaaaaggccaaccgggctgtagccaatcaaacaatttacggcacgagaatcaaggaaaaagaggtcaccaagagggggaaaaaggagaaaatacaggaacgatacactctgggaacaattaagaacatctatgacatcgatggttttatgaatttcaagaaattatacgacaagattagtaaaaacgacgatgtgaagtttctgatgcagaaaaatgaccccaagacctgggagaaacttatagatatcttcaacagttatcctgacagcgaagaggttacacaagtggatggcaaagtcaagcgcgtggcagtttccccatttaaattgtactatcgggagaatgggttcattactaagtactctaaacacaacgacggacccaaggtggtatcgatcaagtattacgatagcaaagtcggctcccatattgacatcaccccgaaggatgctagaaataaagtgatactccagtcactgaagccttggaggacggacgtgtactttaacagtatcacccagcagtatgaactactgggtctcaaatactctgatctgaagttcacaaatggggtctatggcattactcgtgacgcctacgagaaacttaagcacggagttagcgaagacggcgtgaccgcgtggaagcccatctccaaaaactcagagtttcgcttcagcttgtatcggaatgatagagtaagggtgattgacgaaaagggggattctatcgagctgttatttgcctcccgaacaacaagtaacgagggatacgtcgaactcaaaccaatatataaggctaaattcgacagcaaggaggaagtgggcttctacggtctggtttctaacgggcggcttattaagaaaatgtccaagggaggctacaaactgtataaggtgaataccgatatcttgggtaaaccttactatgtcacgcgcgagtcagacgaacccaagctcagtctgtga

SEQ ID NO: 2865 - RNA, 3516 nt, synthetic construct
  misc_feature 1..3516: note = Cas9 variant
  source 1..3516: mol_type = other RNA
atggccaagtacagcgtgggcctggacatcgggatttcctctgtcggatgggctataatcgatattgagaccaaacagatcgttaacctcggttcaagaattttccccagtggcaatgcagccgggaaccaagaaaggcggggatttcgcggcatccgacgtcttataagaaggcggaagaatcgcctgacagacttgaaaaagttactgggtgagactttctttagcgatctcaaaaagatcgactccaacgggtatgaatactatgatattgacttccagatcaatgcgaacccttacgagctaagagtgaagggaattacggaaaaactgtctaagaaagagcttgctgtagtgctgcaccatatcataaagcacaggggcatttcgtatgatttgggcgacctcgaggatgacgggacctcaggagtcagcgattacaaaaatagtatcaacattaatcggcagctgctgcgcgaaaagacagtgggtcagatccaactcgagcgattaatcgaatttaaccaggttcatggccaggtgaagaaagccgaggacgtctccctgcttaatgtgttcccatctagcgcatatagagatgaggccaacaagattatgataaaacagcaagaattttactccgagatcactaattcattcatggaacaggtagaccagttggttagtaggaagcgggactactttattgggccgggaaacgagaaaagccgtaccgattatggcatctacaagtctgacggtcgcacactggataatctattcgctgaactcatagggaccgacaaaattaacggagagaagagagcatccgcctcaagcctgactgctcaggtgtataaccttctgaatgatttgaacaatctccacgtcagtaacacagaggacggcaagctgaccacgtctactaaaaaggaaatcatcaaagccgcgaagaccacagatggcgtgtttgggatttcccaaatctgcaaaattataggatgtaagaaggaggaaatcactggtttcaggcaggacaaaagcgagaagaaagtgattcataccttagcaggctaccggaagatccgaaaagccctggctacaatcaatattgaagccaacgagctcaatcccaccgtctttgatcagatagcagacatccttacgctgaacactgagaaggctgaaattcgcaagcaattggataaagttcagctagacatcacagacgagatgaaggaactggtgattgataaaaataaggacttcctcgtagatgggagagccacctggcactcgttctcttatcagactctgaacatgcttatccctgagctgttgaatacatccgaagaacagatgaccatactcacgaggatgggactgatgaaatcagacaacgagaagtaccggggcttaaagaaaatcccagcggaaaagattgccagtgagatctttaatcccgtggtcgcaaaaagcacccgcgaagctattaaggtgttcaacgccatctccaaagagataggtaagaataacattgagcacgttgtgatcgaactgcctagagatgacaacgaggaagatgagaaaaggaagattcaaaagctacagaaagctaatgaaacagagaaggaggccgcagacaacctcgtcaaacataagctggggatctctgatagcgcccttatagctcactatcgtaaatttaagggcttgtcacagaaggtgcggtactggtaccagcaagaaacttattgcccatactgtggaaaaatcattgaggcgacccagctgatcaataacaatgacaacttcgaagtagatcatattatccccataagtgtttcctatgacgatagccagaataacaaggtgctcgtccactctcagtgcaatcaagcaaaagagaagcagacacctctgggctggattaacaatgggggaggttttggccagagcaaaaacgaatacactaatcgagtgaagaacaataagaaatatagtaagaacaaagtcgacaaccttctgaatgagaccgacttgacagatatcatcacccagagatcattcattcaaaggaacctcaatgacactcgctacgccgctcggacggtgctggatgagttttattccttctttaagtctaacgacttaccaacaaaagttaaggtggtaagagggaagtggacctcgcagatgaggcgcaaatggaataacgtcggaggcctgcgaaagactcgggatacccaccatcaccatgccatcgacgcaagcattatagcctccttcccgctactccgtgcttttgatagagccatcaaactgattgacgtggataaggaaacaggtgagatcgttcagtacgggaaagcatcacttaatggcgacgtgattgaagagaagagtgtcatccaagcgcccataatcaaaaacgaaaagttcgagaagttggtggatgagatttacaattttcctctgttcaaacaggtagaactcgctaacaatatcgagaacccagaaaatcccgtgaagttctctcaccatgttgacaaaaaggccaacaggaccgtcgcaaatcagactatttatagcacacgcatcaaaaagacggagaagatagtgcggaaaaaggtgaccgccaaagaggaagagtacgtcattggaactatcaaggatatctatgacgttacaaactttgaaaaattcaagaagctgtacgacgagtccagcaaaaaggatgacattaaatttttaatgcagaagaacgatcctaaaacctgggaaaagctggtggagataatgaatacatatccagactacgaggaaatctcacaacttgatggcaaggtgaaaagagtaaaggtctctcccttcaaattgtattttagggagaacgggttcattactaagtacgctaaacacaataacggaccgaaggtggtttccatcaagtactatgacagtaaactcggtaatcacattgatatcacccctgtgaacgccaataacaaggtcatactgcagagcctaaaaccctggcgaacggacgtgtactataataacgaaacccagcagtacgagctgctcggcctgaagtattctgatcttaaatttacaaagggggtttacggaatcactcgcgaagcatatgagaaattgaagtacggctacaccgacggtgtgccagcttggaagcctatttccaaagagtcagagttcaagtttagtctgtatcggaatgatagagtaaggatcattaacgaggccggggagaaaatcgacttactcttcggcagccgtaatgaaacatcggaaggatacgtcgagatgaagcccatatttaaaactaacttcgacgatgcggaggaagcctccttttatggcaagacctctaataagcgcctgattaaaaagatggctcggaaagggtaccaaatctataaggtgaacacggacatccttggaaatctgtactatacagcaaaagagagcaacgaaccaaagttggatctctga

SEQ ID NO: 2866 - RNA, 3519 nt, synthetic construct
  misc_feature 1..3519: note = Cas9 variant
  source 1..3519: mol_type = other RNA
atgagaaagccctacagcatcggcctggacattgggaccaactccgtgggatgggccgtcataacagatgactataaagttccttctaagaaaatgaggatccagggtactacggatcggacctcaattaagaaaaatctcatcggcgcacttctgttcgacaacggggagacagctgaagccactcgcttgaagcgaaccacacgtagaaggtacacccggcgcaagtatagaattaaagagttacaaaagatctttagtagcgaaatgaatgagctggatatagcgttctttccaaggctatccgaatctttcctcgtgtcggacgataaagagtttgagaaccacccgatcttcggaaatctgaaggacgaaattacttaccataacgattatcccacaatctaccaccttcggcagaccctggctgactcagatcagaaagccgacttgcgcctcatttatctggcactggcccatatcataaagtttcgaggccacttcctcattgagggtaatttagatagcgaaaacacggacgtacatgtgctgtttcttaatttggtcaacatctacaataacctgttcgaggaggacattgtggaaactgctagtatcgatgcagagaagatcctaacctccaaaacatctaagagcagaaggctcgaaaatctgattgccgagatacctaaccagaaacggaatatgctttttgggaacctggtttccttggctctcggactgactccaaacttcaagaccaattttgaattactggaggacgccaaactccaaatctcaaaggatagttacgaggaagaccttgataacctgttggcgcagattggcgaccagtatgcagatctattcatcgccgctaaaaagctgagcgacgccatactcctgtctgatattatcacagtgaagggcgcatccaccaaagctcccctttcagccagcatggtccagcgttacgaggaacaccaacaggacctggcgttgctcaagaatctggtgaaaaagcagatccctgagaaatataaggaaattttcgataacaaggagaaaaatgggtacgccggatatatcgacggtaagacgagtcaggaggaattttacaaatatattaagccaatattactgaaactagacggcactgagaagctcatctctaagctggaacgcgaggatttccttagaaaacaaaggacatttgacaacgggtccattccccaccagatccatttgaatgaactgaaggcaatcattcggcgacaggagaaattctacccttttctcaaggagaaccaaaagaagatagaaaagctgttcacctttaaaatcccatactatgtaggaccgcttgctaatggccagagctcgttcgcctggctgaagcgccagtctaacgagtccattactccctggaattttgaagaggttgtggatcaggaggcttcagccagagcattcatcgaaaggatgacaaactttgacacctacttgcctgaggaaaaagtcctcccaaagcacagtcccctgtatgagatgttcatggtgtacaatgaattaacgaaagtgaagtatcaaaccgagggtatgaaacggcctgtctttctgagctccgaggataaggaagagattgttaacctactcttcaagaaagaacgcaaggtgacagtaaaacagctgaaggaggaatacttctctaaaatgaagtgctttcatactgtgaccatccttggggtcgaggacagattcaatgccagcttgggaacatatcacgatctgctcaagatatttaaagacaaggctttcctggatgacgaggcgaaccaggatatcttagaagagattgtgtggactctgaccctttttgaagaccaggcaatgatcgagaggcgtttggttaaatacgccgatgtgttcgaaaagtcagtcctcaaaaagctgaagaaacggcactacacaggctggggccgactaagtcaaaagctgattaacgggatcaaagacaagcagaccggaaaaactatactcggttttctgaaggacgatggcgtggctaatagaaacttcatgcagcttattaatgactccagcttggattttgccaagatcattaaaaacgagcaggagaagacgatcaaaaatgaatctctggaggaaacaatagcaaacttagccgggtcaccagctatcaagaaaggcattctccaaagtatcaagattgtagacgagatcgttaaaataatgggacagaatcccgataacattgtgatcgagatggccagggaaaatcagagcaccatgcagggtatcaagaactcccgccaacggctgagaaaacttgaggaagtccataaaaatactgggtctaagattctgaaagagtataacgtgtcgaatacccagttgcagagcgacaggctctacctgtatctactgcaagatggcaaggacatgtacacaggaaaagaactcgattatgacaacctgtcccagtacgatatcgaccacattataccgcagtcattcatcaaggataatagtattgacaacaccgtccttactacacaggcatctaaccgcggcaagagcgacaatgtgcctaacatcgagacggttaataaaatgaagtccttttggtataaacaattgaagtcaggggcgattagccagcgaaaattcgatcatctgaccaaggctgagcggggagccttatctgactttgataaggcaggtttcatcaaacgtcagctcgtggaaactagacagataacaaagcacgtagcccaaatcctggactccaggttcaacagtaatcttaccgaggatagcaaatctaaccgcaatgtcaagattatcacactgaaatccaagatggtgtcagactttcggaaggatttcggcttttacaaactaagagaagttaacgactaccatcacgctcaggatgcctatctcaatgcagtggtcgggactgctctgttgaagaaataccccaagctggaggccgaatttgtgtatggagactacaaacactatgatttagcgaagctcatgattcagccagacagtagcctgggcaaggccaccacgaggatgtttttctactcgaaccttatgaatttcttcaaaaaggagatcaaactggctgacgataccatatttacacgacctcagattgaggtaaacactgaaaccggtgagatcgtgtgggacaaggttaaagatatgcaaacaatccgcaaggtcatgtcctatccccaggtgaatattgtgatgaaaactgaagtccagaccgggggcttctctaaggagagcatatggccaaagggagactcagataaattgatcgcacggaagaaaagttgggaccccaagaaatacggcgggtttgattcccctattatcgcctactctgttctcgtggtggctaagaactgtaagaggaaaaatagcaagacgaaaaactatcaaagaacatgcggaaacaagaataacggtacccgttga

SEQ ID NO: 2867 - RNA, 3522 nt, synthetic construct
  misc_feature 1..3522: note = Cas9 variant
  source 1..3522: mol_type = other RNA
atgagacccatcgagccttggattctgggcctcgacatagggaccgatagccttggatgggccgtgttctcctgcgaagagaagggtccaccgacagctaaagaactgttgggcgggggagtcaggttatttgactctggccgggatgcaaaggaccacacttcacgccaggccgagcgaggtgcgttccgtagagctaggcggcaaacgcgcacctggccctggagaagggatcggctgatcgccctatttcaggcagccgggctcacacctccagctgcagaaactcgccagattgccctggcccttcgaagagaggctgttagtaggcccctggcgcctgacgcattgtgggccgctctcctgcatctggcccaccatcggggattccgtagcaaccgcatcgataaaagagagagggcagctgccaaggcgctcgccaaagcaaagccagctaaggccaccgctaaagccacagcacccgccaaggaagctgacgatgaggcgggcttttgggaaggcgcagaggccgctttacggcagcgaatggccgcatccggggcccctaccgtgggagctctgcttgccgacgatttggaccgcggtcaaccagtaagaatgaggtacaatcagtctgatcgggacggcgtggtcgcaccgactcgcgcgctgattgctgaggaactagccgagatcgtggcaagacagtcgtcagcctatcccgggctcgactggcctgctgttacaaggctggtgcttgatcagcgtccactgcggagcaaaggagccggcccctgtgcattcttgcctggtgaagaccgagctctcagagccctgccaaccgtccaagattttataatcaggcagacgttagcgaacctgcgcctccccagtacttccgccgacgagccgcggcctcttaccgatgaggaacacgctaaggcactggccttgctatctacagctagattcgtggagtggcccgccctgaggcgcgcactcgggctgaaacgaggagtaaagtttactgcggaaaccgagcggaatggcgccaagcaggctgcccgtggcacagcagggaaccttaccgaagctattctggccccattgatccctggatggagcggttgggacctcgatagaaaagacagggttttctccgatctgtgggcagcccgccaggaccggtcagctttactggcgctaattggcgatcccagagggccaacgagggtgactgaggacgaaacagccgaggcagtcgctgacgccatccaaatagtgctccccaccggacgagccagtctgagcgctaaggcagcccgcgcgattgctcaggccatggcacctggcatcggttacgatgaggccgtgactcttgctttggggctgcatcactctcaccggccaagacaggaaaggctcgcacgtctgccgtattacgccgcggcccttcccgacgtcggcctggatggagaccctgttggcccaccccctgctgaggatgacggggcagccgctgaagcctattacggacgcattggtaatatctccgtgcatatcgcattgaacgagacacggaaaattgtaaatgctctcctgcacagacatggcccaatattaaggctggtgatggtcgaaaccacgcgagagctaaaggccggggcggatgagcggaaacgcatgatcgccgaacaagcagagagagaaagggagaacgctgagattgacgtggaactccggaagtcagatcgatggatggccaatgctagagagcgcaggcagcgtgttcggctggcaagaaggcagaacaatctttgcccctataccagcacaccgatcggacacgccgacttgctgggcgatgcctacgacatagatcacgtgattcctctcgctcgcggtgggcgagacagtctggacaacatggtcttatgtcagtctgatgcgaataaaactaagggcgacaagaccccatgggaagcatttcatgataaacccggatggatcgcccaaagagacgatttcctggctcggcttgaccctcagacagccaaggcattggcctggaggtttgctgatgacgcgggcgagcgcgtggcccgtaaatccgcagaagatgaggaccaggggttcctccccagacagctgactgataccggatacatcgctcgggtagccctaaggtatctgagcctcgttacaaacgagccaaatgcagtggtcgccaccaacggtcgcctgactggccttttgcgactggcttgggacattacgcctgggcccgccccaagagatttactcccgacacctcgggacgcgctgagggacgataccgcagcccgcagattccttgacggactgactcccccacccttggctaaggccgtggaaggcgctgtccaagcaaggctcgccgctctgggtcggtcgcgtgtggccgatgcagggctagcggacgccctgggcctcaccctggcttctcttggaggcgggggaaagaaccgcgccgatcaccgacatcactttatcgacgcagctatgattgccgttacaaccagaggcttgataaatcagatcaaccaggcatccggtgccgggaggattctggatttacggaagtggcctcgcactaatttcgagccaccctaccctacatttagagctgaagtgatgaagcagtgggaccatatccacccgtcaatcaggccagcgcaccgggatggaggcagtctccatgccgcaacggtattcggtgtccgaaacagacccgacgctcgcgtgctggttcaaaggaaacctgtggagaaactttttctggatgccaatgccaaaccactacccgcagacaagattgctgaaataatcgacggcttcgccagccctcggatggcgaaacgttttaaggctctcctggccagatatcaggcagcccacccggaggtgcccccagctttggcagccctggcggtcgctagggatcctgccttcgggccccgcggaatgaccgcaaacactgtaattgccggccggtccgacggggatggagaggacgctggcttaatcacaccatttcgagccaatcctaaggcagctgtgagaaccatgggtaacgccgtttacgaagtctgggagattcaggtgaaagggaggccccgctggacacatcgggtgctcactagattcgatcgtacccagccagcgccgcctcccccacccgaaaatgccaggctggtcatgcggcttcgccgaggagacctggtttattggcctttggagtctggcgatagactctttctggtgaagaaaatggcagtggacggtaggctagctctgtggccagcccggcttgcaacgggcaaggctaccgccctctacgcccaactgagctgccccaacatcaatttgaacggggatcagggatattgtgtacagtcagcggaaggcatacgcaaagagaagatcagaacaaccagttgcactgctctggggaggttacgactctccaagaaagcaacatga

SEQ ID NO: 2868 - RNA, 3525 nt, synthetic construct
  misc_feature 1..3525: note = Cas9 variant
  source 1..3525: mol_type = other RNA
atgggcaagtacagcatcgggctggacattggaatatcctctgtgggttggtcaatcattgatatcgagaaaaagaaaattgtcgacctcggcagtagaatcttccccagcgggaacgccgctgcaaatcaggataggcggggatatcgcggcacccgacgtcttataagaaggcggaagaaccgcctggccgacgttatcaactttttgggtgaagagaatttcattgatacaaaagtggtagaccaaaatgggaacatccactacaagttactggtaaattccactgaatctccttataagctaagagtcaaaggactctcgaagatgctgacgaaacaggagcttgtgattgcgctgtaccatatcgttaagcacaggggcatatcatatgatttgggcgacctcgaagatgacgggaccagcggagtgacagattacaaaaccagtattaacatcaatcggcagctgctgattaagaagactgtcggtcagatccaactcgagcgcttaaaagagtttggcaaggtgcgagggcatgtgaaaaaggacgaaaacatcacactgcttaatgttttcccatcctctgcttatgtgaaagaggccacccagattttgactaagcagagagaattttacccggagataacagatgacttcatcaccaaatttattcccttcatcagcaggaagcgggactactttgtcggacctggcaacgagaagtcccgtacggattatggtatatacaaaaaggacgggcgcactctggataatctattcgacgaactcattggaatcgataaaatctcaggcgagaagagagcaagtgccagctctgtgaccgctcagatttataacatgctgaatgaccttaacaacctgacagtgactaataccgaagatggcaaattgacaacccaaacgaagagggagatcattgaagcagacaagactacaaacgggctctttggaataacccagatctgcaaaattatcggttgtaagaaagatgacatcaagggcttccggattgataaagtcgagaagccaataatgcacactctgtccgggtaccgacgctttagaaaggagttagccaaaatcaatattgaagctaacgacctggacatcaatctcgttaacaagattgccgatatccttacactgaataccgagaaagcggaaataaggaagcagttgaacaaatcaaatatcgacgtgagcaacgagattaaggaactaatcattaataagaacaaagatttcctggtagacggacgggcaacgtggcatagtttctcttataagaccctcaatctgcttatccccgagctgatgaacacatccgaggaacagataactattttgacccgcctcggcctggtgaaaagcaattcggagaagtacaaaggtttaaagaacatccctgccagaaggattacagaagggatctataacccagtcgtggctaaagccactcgtgaggcagttaatgtgtttaacgctatagccaagaagatcggccgggataatatttctgacgtcgtgatcgaactgccccgagaggataacgaggcggacattaaaaagggaatcgtaaaaagacaaaagcagaatgaactagagaaagaagccgcagatgctctcgttaagcagcaaatgaccatatccgactcagccctggtggctcactacaggaaggtccgcggccttagtcagaaagtgcggtactggtatcagcaggggacatgctgtccttactgcggaaagaacattgaggccgtccaattgatcaataacaatgatagcttcgaggtggaccacatcattccaatctccgtttcttttgatgacagccagaacaataaagtgctggtacattcacagtgtaaccaggcaaagggtaaacaaaccccgctcggctggctgaataacgggggaggcttcggtcagaataagactgaatatgtcgccaaggtgaaaacgaacaagaactacagtaaaaataagatggacaaccttctgaatgatatggacttgtccgatattgttacacagagagggtttatacagaggaacctcaatgacacccgctatgctagccgaatcgtgctggatgagttctactcatttttcaaatctaacaatttaagtactaaggtcaagattgtgcggggcaaatggaccagccaaatgcgtaagaaatggaacggagtaggcgggctgaagaaaacaagagacacctatcaccatcacgcgatcgatgcatccattatcgcctcttttcccctactcaaggtgttcgacaaagctataaagctgatcgatattgacagggaaactggagagatccttcaggataaggaagccattaaaatgtcgcaggaggcaaagttgctggagaaaatccctgttatacagaatgaaaagtttgaggaactcattaacgagctgtacgacttcccattatttaaacaagtcgaactggccaatgatatcacaaaccccgagaatcctgtgaagttcagccaccatgtggacaagaaagctaaccgctccgtcgccaatcagacgatctacggtacccggattaaggagaaagaaataaacaagagaggcaaagttgagaaggtgcaggaaaggtatatccttgggactattaagaacatctacgacattgattcattcacaagttttaaaaagatctatgacaaaatgtctaagaccggagatgtgaaattcttgatgcaaaagaaggacccaaaaacatggggcaagctcgtagagatactgaatagctaccccgattccgaagagatcactcaggtcgacggtaaagtgaagcgagttaaagtgtcaccgtttgagctatatcgccgggaaaacgatttcattaccaagtacgcaaagcacaatgacgggcctaaaatcgtcagcattaagtattacgattctaaaatcggctcccatatagacattacgcccatcaacgcgaagaataaagtggttctgcagagtctcaagccatggagaaccgatgtgtactttaacagcgagacaaggcagtatgaactgcttggattgaaatactctgacctgaagttcactaatggcgtatatgggatcacctccgaggcttacgagaagttaaaacacggaatttcagaagacggcacaaagacttggaaacctatcggtaagaacagtgggtttcgtttcagcctctatcgcaataaccgggtcaaaatagtggatgagaagggagaatcgctggagcttctgtttgcctccagaaccacgtctaatgaaggctacgtggagttgaagcccatttataaaagcaagttcgactcaaaagaggatgtcggtttttacggccaaatgacaccaagtgggcagttcgttaagaaaatggcaagggtgggatacaagctctataaggtaaacaccgacgtgctgggcaatccctactatatcactaaagaatccgatgaccctgagctatctctgtacaagaaatga

SEQ ID NO: 2869 - RNA, 3528 nt, synthetic construct
  misc_feature 1..3528: note = Cas9 variant
  source 1..3528: mol_type = other RNA
atggaggaaatgaagcagaccggcagaaagaacgaggcccccaagctgacagacctcaattacaggatcgggcttgatattggaatagctagcgtgggttgggcagtcctggaaaacaattcccacgacgagcctttccggatcattgatttgggcgttcgcatctttgacactgccgaacaaccaaaaacgggggcgtctttagctctgccgcgacgtgaggccagatcagcaaggcggcgcattagaaggcggcgcgatcgaatcgagagaataaagaaactattccaggccgaaggactcatcaacattgacgagtttgaagctaggtataagatcgcaggcctgagtgatgtgtacaaacttcggtatgagggtctggaccgtaaattgaccgatgacgagctcgcccaggtactgctgcatattgctaagcaccgcgggttcaaaagcacatccaaggccgaagaggcggaaaatgagaacgatgcagccaaaaagaaggaagctggagccctcaaaaagggcatctctaataacaaaaagttaatggaggagaaaggctacagaactgtgggggaaatgatgtatctggacgagaattttaggaccgattgcccctggaacgaaaatggatacatacttacacctcggaacaagtcgggtgactataaacataccgtcttgcgagacatgctggtggatgaggttcgcgaaattttcaagtcacagagaagcctaggcaatatccacgcaagtgaggagctcgaaaacgcttacctggacattatgctttcccaaaggtcttttgatatggggccaggagcccccagcaagtacgcgatggagggcttcgaagaccgggtgggtctgtgtacttttgaggggaaaaatggagaaaagcgcgccgcaaaagctgcctatacatccgagttgttcgtcgctctcgagaagatcaaccataccaaaatcgtgtcagatgacggcgccacgagatttctgactacctacgaaaggaagagtattatagagttaatgcacaagcagcagacagtaaaatatgcagccgttcgtaaggctatcggcctggcggaagaggataaattctacaacctcaattatagccctaaggcagggtctaaaaagtccccagaggacactgattttgtgaaacttgaaaactaccacaaaattcggaaggccctgggagaggacatcgtctcagaacatttgcccgctgagaaaataaagctatatgatagcattgccaccatcctgacactcttcaaaaatgacgacagtcgaatcaagagattcattgaactgggtatcggcgaggagtgctttgatgggcttctgtctttgtcccctagcaagttccacaacctctcgctggtggcaatgggaaaaattataccatttttactggacggcaatacctacgataaggcctgtgaactagctggttacgacttcaaagccgataacaagggggagaaatctgtgctcctgaagggcaaaaatatcacggacatggtcaacgatattactaatccggttgtgaggcgctccgtatcacagacaatcaaggtgatcaacgcaattatacttgaatatggaagtccccaagcggtcaatatcgagttggctcgggaaatgagcaagaactttgacgagagaaggaaactgaagtccgatatggagtctcgcgaaaaagagaataacaatgtgattaagcgagttaaagaatacaagctcaaccctaccggccaggacatcgtgaagttccggctgtgggaggaacaggatcgtagatgcctttatagcggggagaaaattgacatcaacgatctgttttcaagggacggaggttacgacgtcgatcatatattgccatatagtatcactttcgacgatacataccgcaataaggtgctcgtaaaagcctccgagaaccggcagaagggcaatagaaccccctatgaatactttatggcagagaaagacgatgacgaatggaacgtttacgagacgctggtgaggaataccgtcaaggattataagaaagtgttaaagctgctcaaaaagcacattacagaggacgaaaagagcgagttccgagaacgcaacctaactgataccaagtacatcacacggattatctataatatgataagacaaaacctggtccttaagccttacttgtctctggagaaagaaaggaagaaacaggtgatggccgttaatgggtcaattactcactatctcagtaagcgttggggactggagagcaaagaccgccggaccgatacacatcacgctcaggacgccgtggtaatcgcatgtaccactgatggcatgattaacaagatctccagatactctaaaggtagggagttactgtattcgcgagggtttaagttcgtcgacgaagagacgggcgaaatacttagccgggacaattttacacgcgaggaatgggatgagaagtacggagtgaaaatcccaattccctgggagcatttcagagacgaattggatatcaggatgtcccggtacaacggcaccggggacgattcaattgacaagactaccccgcgagatttcatcctcagtcacagagacgctcataaatggataaattatcctgagtggatgtttgttgaaggacgccccggtaggcgtggcgtgctggatgggattttcgtctctcggatgccaaagcacaaagtgagcggacaagcccacgaggaaacagtaagatccgcgaagtactataacgacggcggttcagtgtttgagagcgggggctacgttgtcaccaagaaatctatccaggatatcaagctaaaagacggagagattaaggagttctttaatcctgactccgataggctgctctataacgccctggtggaccgccttaacaaattcgaaaatgatcccaagaaggcttttgcagaaccattctacaaacccaaggccgacggcactcaggggcctatcgtgaaaaagattaaagtctttgagaagcagagtagcggagttttcgtgcgagatggcaagggtatagctgccaacggggcaatggtgagaatcgacgtattttgcgaggaagataaaggaaagaaaaagtattacttcgtcccaatttacacagcggacgtggttaaaaagaagttgccggatcgggccgctacggccaataaactgatctctgagtggagggtgatgaaggaagagaactttattttctccttatattcacgcgacctcatctacatagaaagtgataaaggcgtccaagtgaaggacatcgatggtaaaattagcaagcccgttaatctgttcgcatattaccttggcgctgacacctcgactgcctccatctctgggaaactgcatgacagctcagcaaactttcgtagtattggaatccagggcttgagacggttcgataagtgtcaggtggacgtactcgggaatatatcctttgtcaacaaggagaaaaggatgcctttcaattga

SEQ ID NO: 2870 - RNA, 3531 nt, synthetic construct
  misc_feature 1..3531: note = Cas9 variant
  source 1..3531: mol_type = other RNA
atgaacaaggtgcaggaggactgctacaaaaagatcaaagaaaagctggccgatagagagtataggattggcctcgaccttggggtcggaagcataggttacgctgttgtgtccctgaaaggcgatatgcccgaagacgtaatcttggcagggtctcggattttcaagtcaagtatcggagccgcggagcgccgacactttcgtgctcaaagaaatacccataggcaccatcgggaacgcatgagatatttatggaagctgctagccgagaaaaacctcgcactgcagcttcctgagaatctgagcaagaaagaaaacttcacagattttgacacttccaggaagcggttcccaattgaggtgttgcgcaatgatccgtacatcctccgatataaagccctggacgaaaagctgtctctctttcagttaggctacgctctgtatcacatagcaaaccatagaggtacggcctcggtcaggtcattccttgaggatgacgaggctaaggtgaaagaaaataaggagaccgccaaattggcgaagaacacaaagaagatcatgtacgagaaaaagtaccggacttttggggaatatctgtaccgtgaacgcattgagaagttcagacagaatgagaggatgaaagttaccaacaagaatgaaaacaaagagtttgcagtgacacgggatatcattgaaaaggaggtcgaaatgatcctaggagcccaaaaacgatataataccgctgtgctcgccgacgattacatagagcgcattaagaaggcaatcttctatgagactgaaaaactgattcccgagcctgaatactgtccatattttaaggacgacaaaagacttcccaggagccacaagctgaacgagtaccggcgcatctacgaggctttgaataacacaagatattacatccctgaaattgaggagaaaaccggcgaaatactcagtaggaaggaaaaggagcagctgtccaaagaggaaaaggagaaattattcaactttctgctcaagaataaagaacttacggaggccaaggtaaagaaactgttgaacctatctgaaatggcgaaggttcagctgcagggccgtgataaaaagaatcagaaaatcaaggggtatgccctcattactctggagagccttccattctggtccaaactgcccgagcaacagcaggacgagttcttgtacgattggaacaagctccctgacgaaaagctgaaagatcggttacgaaattattacaagctgaccgacgatgaaatcgacgagacatttcaaaacatagtgctaccatcaaattatgcaccgctcggtaaaaaggctatggaaattctgcttgagtacatcaaaaacggattgagttacatcgaggccctggataaggctgccgacgaaaataagattaaagtcgagaagcacgaaatcaacgatctcctgccctattacggcaaaattcttcaggagagcactcagatgcctatagggaaggcattctctaaacaatttgccgctaagaattataagaaaccagacatcaacaagaatgaacaggagttcggaagaattgcgaaccccgtggtgcatcagaccctgaatgagttgaggaaactcatcaacgaaatcattacagtctttggcaagaaacctctggagatatccttagaaacctcacgcgagctgaaaaagagccagaaagagcgggaactaatcgcaaagcaacaggacattgatgaggagaaaagaaagaaaatctggaagacgtacattgaaccacacctccagcagatcaaaagtaggtctgacaagctgaagaaacttttcgtttttgaattgtgggaggatcaaaagcataactgccccttctgtctggagaaaataaatgtggacgatatctattcccgcggtgtagacaaggaacacctctttccgctgaaaaagagcgaggatgactcggaaaacaatttagtgattgcccacaacaagtgcaatgctcgaaaagccgagcgggcacctttcgatgcctttgggcatgaatctatctggaacgacattttctccaatgctgagaagaacctgccccgtaaactttggagatttaggcagggatcattcgagaagttcttggaaaaaccacctatgctcaagcgctttgagactgataatagttacatcagcaagatatccgcccggtatctggcatgtctattcgacaaaccctctaagatcttttgcgtcaaaccattcctgacagcgcagctcagaattgcttggcagctggatgaaattatgatcaggcttgccgagaacataatcttggacagcgaaaaggactcatttaataaaggcggcctgcaaaagaagaaacgaattgataaccgccaccatgcattagacgccgtggttatcgcttacgccagtcgggggtaccacaatttcctcaacagagtgcatgcaaagggatataaaattaattacgatgagaagacctggctgtccgagactcttaggccccctggtaacaaaaacctggaagactttaagagcggcatcataaatgtcatgattaacgctaatatctctatcaagcacgatcacaacaataaagggcagttggtgaagtcaaaagcctataagctctactatagtgagattggaaaatacatcattacaacccttaagagcgtatccgaaatactattcaaacagaaggagaagccacaggacacgctgcgtcgcgcgctctgtaaatttgaggatcggctgtctgacatcaaggataaaaagctgaggaaaaagttggaagacaacattaccatctataagtcgattgagaatgaaagcgccctgtccaaagctaagcaagagttagaagagttcgatctcaaagcaaagaaagagggcaagaagggttacgagaaaatcacagacatactgatctacaagaaagcctgctcaatgcatgggggcaagtatattcacgttaaaaacagaatcgaaaataagtttttcgctcttaaggaaccgactgagattgaaaccggatttggctacgatacagccgacaacctgagtctagacctctatcatgataataacgggaaactgtgtggagaggtgatccgaaagatagacttcaatcggaaccgcgtccccaattacaaaaaggagggttatattttgctggaaagaatctaccagggcgatactttagaggtggacatctctgatgacaaaattagcctcaagaacaaagtcgggtccgcacctgataagaggaccttcgtgaaggttctgacatttaccgaatcagaccggtatcttaaaaacaagcgagatcagatacaaatcttcttttgcaatctgttgaaaagcactctcaagcacgacgattcttccaaacacgacgacagtttctacgtgagctctatgcagaagtacaacgtaagaaaggtcattctgacgtccctaggaatcattaaatatcgctcaaagatcctgaaaaataaggagatatga

SEQ ID NO: 2871 - RNA, 3531 nt, synthetic construct
  misc_feature 1..3531: note = Cas9 variant
  source 1..3531: mol_type = other RNA
atgctgttccccaagaaactcagcaaggaggaagtggcctacgtccttgttgagatcaactccaatctgaacaattcttcaaactatttgggcaatattagtgacagaagcaaagaattatactttaacaagcagaccatagggcaattcctgtatacaaaactaaaggaggataggcactactccctcaagaataaagtgttttatcggcaggactacctggatgaatttgagcgcatctgggagactcaggctatttttcataaggaacttacggaggacctgaaaaagcagatccgagataccattatcttctatcaacgtagattgaaatctcagaagggactcatatcgctgtgcgaatttgagaacaaggagatcacaattgaaaaagagggtaagactgtaaccaaacagatcggcgtgagggtcattcctaagtcaagcccactgttccaggaatttaaaatctggcaaatactcaataacgtgatttgtaagaaaaaggggacacggaagaaaaaggcagttaccccggcccccttactgttcgagctttttggaactcctagtgaaacattcttttccttggacatggagtgcaaacagctgctattcgaggaactcaatctgaagggcaaccttaaagcggataaggtgatccgcctgttgggttacattccacaggagtgggaaatcaattacaaccagctcgaggggaatagaacccaaaagtctctgtatgaagcatacttaaaaatcattgagatagagggatatgacatcaagacgttcctgaggattaaaagcgataaggaagactgggatctcgaggaatcacccctttccgccaaagagatccgggaaaacatacagcacatttttgagactctgggcatcagtaccgcaatcttgtacttcgacgccacactacctattaaggattttgagaagcaggctagctatcaactgtggcatctcctgtactcttatgaatccgacaactcaccaagcggcaatgagactctttacaaactgttgcaggacaagttcgggtttaaacgcgaacacgcagtcttcctcagtaacatctcttttcaggatgactacggatccctgagcgccaaggctattcgaaaaatatatccctacatcaaggagaatcagtattcgaccgcctgtgagttagcgggttacagacattctaagctgtccctaacaaaagaagaactcaacaataggcctctgaaggatcttatttcaccattgaaaaagaacagtctgcggaatccggtggtagaaaaaggcctcaaccaaatgatcaatgttgtgaacgcactgatcgagaagaatagcgaaaaagacgccgaggggaacattataaagtatttccactttgatgagatccgtattgaacttgctcgcgagctgaagaaaaatgcccaggaaagagcagagatgaccttgaacatcaagaatgctacgattgaacaggagaaaatcaagtccatactcatctctgacttcggaattaaaaaccccactaagaacgatatcacaaggtaccggctgtatcaggagttagcccacaatgactacaaggatctgtacaccaacactgacattcctaaagaactactctttagcaagaatatcgatatagagcatattgtcccaaaagcgcgagtgttcgacgactcatttagtaacaagacactggcctatcgcgatttcaatcttaaaaagggcgaaaacaccgcattcgactttatcgattccagcttgggtgaggaggagctgaatcaatacattgctagagtggagaacgccttcaagacgaaaaatatctctgctaccaagtataggaacctcctgaaaaaggccacagaaataaatgacgggtttatcaaccgggatttacgcgagactcagtacattgctaaaaaggccaaggacctgcttttccagatcaccagatcagtcgttagtacaagcggatccattactgataggttgcgtgaagactggggcctcatcgatataatgaaagagctgaatatgcccaagtatcgggacctaggcctgaccgagattatcgaacgaagagatgggaggaaagtggaggtaatcaaggactggacaaaacgcaacgatcaccggcatcacgctatggacgcgctcaccgtggcatttactaagccttcttacattcagtatctgaatcaccttaacgccagaaaagacgaaaacaataagttgtacgctgatatcctgggaattgagaggaaggaaacgacaaaaatacatgacgagaacggtaatgagaagcgcgtcttcatcgaaccaattcccggctttcgacaaatcgccaaaaagtacttagaggaaattctcatctcgcacaaaaccaagaacaaggtggttactaaaagcataaataagatcgcagggaccaacaaaaagcaggagacactgaccccgcggggacagcttcataaagaaactatttatggcaagtaccactattactccaataaggaggagaaaatcggtacaaagttcgataaagaaacgatttcaaaggtgagtaaccctatctatcgttacgccctgcagaaaagattggaggctaatgaaaacaatcccaagaaggcctttaccgggaaaaacgcactctctaagaatccaatatatctggacgatgcgaaaactaagattctacctgagaaagtcaacctgatctacctcgaagaggacttcagcatcaggaagaagattgtgtccgagaatcccacatcaaaagaatttgtaccaaacagcatatctatcgagaagattgttgatgaaggcatcaaacgcattctgaaggagcggcttgagacctacaacaatgaccccaaaaaggctttcgccgatttggacaaaaaccctatctggctgaataaggaaaagggaatatccatcaaaagagtgacaattagtggcgtcaagaacactcaagcattacatagcaaaaaggatcacctcgggaaaccaatcctggacaaggagggacaggaaattccggtggattttgtctctaccggtaataaccaccatgtggccatctatagggaccagaagggcaatcttcaagagcagatagtttccttcttcgaagctgtggtacgagcccagcaggggctgcccattatcgacaaaacgtacaagcaagaggagggatggcagtttctattcaccatgaaacagaacgaaatgtttgtcttccctaatgagatcacaggctttaacccatcagaaattgatctcctggaccccaagaataaaaagttgatcagtcctaacctgttccgcgtgcagaagataagcattaaagattatttcttccggcaccatttagagactaatgttgaaaccaacaatatcctcaaggacattacatggaaaagaggtgggctgtcgcttctgaagggcatcataaaagtgaggattaaccacttgggaaatatcgtctccatcggcgagtactga

SEQ ID NO: 2872 - RNA, 3534 nt, synthetic construct
  misc_feature 1..3534: note = Cas9 variant
  source 1..3534: mol_type = other RNA
atgaacaaggtgcaggagatcgaatacaaaaagattaaagagaagctggccgacagagaatataggataggcctcgatcttggggtcggaagcatcggttacgctgttgtgtccctgaaaaagtatgacgatttgtcttacttacccgaggacattatcctggcaggctcacggattttcgccagtagcatcggggcggtagaacgccgagagtttcgtctacaaagaaattcccacaggcatcggcgcgagagaatgaggttcctctggaagctgcttgctgaaaaacagctggccttgcagccttctaaggatctcgagaaaaaggaaaactcggcagactgcgagacctcacagaaacggtttccaataaatatcctgaagaacgatccgtatattctgcgctacaaggccctcgacgagaaattaagcctgttccaacttggatatgtgttgtaccacgtcgctaatcatcgaggcacagatagtatcagatcctttctggaagacactgatgacaagattaaagagaacacgaagaccgcaaaactagccacagaaactaagaaaatcatagattctaagaagtacaggaccttcggtgagtatctctacaaagaacggattcagcagaatgagcgtaagaaagtgagcaaccgcaagacagctgggaataaaaacaaggagtttgccgttaccagagacatgatcttcaaggaaactgagaaaattctggcgtcccagaagcaatattacacaaatgtgcttaccgacgaatatatcaaagagatcgaaggagcaattttctaccagacggagaagctgatacccgagtcaggctattgtccttacttcaaagatgaaaagaggttgccatgcagtcacaagctcaacgagtaccggcgaatctatgaagccctgaataacgctcgctacagcgcccccgtcttagacgagaaaactggcgaaattctgtcttatcaggagggggaggaattttcctcagaggaaaagaaaatcctcttcgatgaggtgcttctgaagggaaagaagttgaccgagagcgaaataaagaaactactgcatctccctgacggttgtgagattcagctgcaaggcagagataagaggacacagaaaatcaaggggtacgcacttactgctctggaagccttgccattttggagtaaactctctcagcaacagcaggacgagttcctgtatgattggaatggattacccgaagagaagctgaaacctaagctaatcgactgctactccctcaccgagaacgaagtagatgagacattccagaagattcggctgccaagcaactatgcgccggttggcaaaaaggccatggaaatccttttgacctacattaaagacggttactcgtatacggaggcactggataaggctgtgtctgaagggaaatttaaggtcgacaagcaaactacaatatacgactccctcccctattacggaaaaatcctgcaggagtcaacccagaaacttattggcaaagccttcagtaagcagtttgctaaacgcaattataagaagcctaacactaatagaaacgagagggaatttggcaaaatcgccaatccagtggtgcaccaaagcctgaacgagttgcgtaagctcatcaatgaaattataacagtctttgggaaaaagcccctggagatcggattagaaaccgcacgggagctgaaaaagtcctctaaggatcgagagagcctagttaaacagcagaacgaaaatgagtacaacagaaataagatttataaagactacgtggaacctcacctctcacagatcaagagtaggcaagagaacccatcccgctacattttcaaatttgagctgttcgaggaacaaaagagcatctgtcccttttgccttaaagaaataacgccggatgacatcattaattctaaggtagatatcgagcatattttccctatcgaagagtcagaggacgatgccaagaacaatttggtgatagctcacaacgaatgtaacgcggacaaaggtaagaaaagtccctttgatgcattcggcgacaagaccagcgggaaatatgtctggaatgatattctgcataacgccaagaagaatctcccacacaaaatctggcggttttaccagggatccctggagaagttcttagaaaacaaacctatgctgaagagattcggcacagacaattcttatatttcgaaaatcgctgccaagtaccttgcatgcttgtttaacaatagctccaagatattctgtatcaaatcaagtctcactgcccagctgaggattgcttgggagctaaactctatcatgattcccctggccaagaatatcctcagcgaaaaagagctggaggaatttaagacccttaaaaacaagaagatacgcatggataatcgacaccatgcattggacgcgattacaatcgcttatgccaaccggggttaccacaatttcctgaacaaaatccatgcaaaggggtataaaattgactaccgtgagaagaattggttatccaaaatcctcctgccaccccttaacagagatctggaagactttaagatttcagtgaagaacagcatagagaaagccaatgtttctatcaagcacgatcataaaactaacggctccttggtgaagggaaccgcttacaaagtctattacagtggcacagggaagtatattatcaccactctcaaaaatgtggaagagattagcttcaaggagaaggaagaccctgaggatacgctgaggcgcgccctatgcggatttgaagactctaacatcaaagatgagaagctgattaaaaagctcaaatacaattccgacctgtataagaagatccttaacacaaaaccaaaggcaaaacaggagttggaacaggctaatcaggagaccaaggaagagggtaaaaagactcaaaagattaccgatgtactgatctacaaaaaggcctgttcattagttggcgaacagtatattcagtgcgcgagtcggctcgagaacaaattctttgccgtgaaggagccgacagaaatcagaaccgggataggatacgacactggcgataatctgttccttgacctgtactatgataaaacaaggaagctatgcggtgagattatccgaaagatcgactttaaccagaataaaattcccaactaccaaaaggaagggtatatactcttcgagcgcatctaccagggcgacacgctggaagctgataccagcgaggacaaaatttcgttgaagaataaaactggatccgcactggataaccggacatttgtcaaggtgttaaccttcacagagtctgacaaatatttcgatggcaagaaggacaaaatccagatatttttcgggaatctccttaagagcaactacaaacaggatgactcattttatatcagttccatgcaaaagtacaacgtcagaaaagtgatactgacttctctgggaatcattaagtacaggagccagatcttgaagaataaagaagtttga

SEQ ID NO: 2873 - RNA, 3540 nt, synthetic construct
  misc_feature 1..3540: note = Cas9 variant
  source 1..3540: mol_type = other RNA
atgagcaagaaagtgtccagaaggtacgaggaacaggcccaagagatctgccagcggctgggctctcgcccctattcaattgggctcgaccttggagtcggtagtataggcgttgctgtggcagcctacgatcctatcaagaaacagccaagcgacctggtattcgtgtcctctcgaatttttatcccgtcgaccggggcggctgaacgtagacagaagaggggacaacggaactcattgcgccacagagccaataggttaaaattcctgtggaagctactcgcagagcggaacctgatgcttagctatagtgaacaggatgtccccgaccctgcccgcctgcgatttgaggatgctgtggttagagcaaatccatacgagttgaggctcaagggcctgaacgaacagctgacactctccgagttaggttatgccctgtaccatattgctaatcaccgggggtctagctccgtgcgtactttccttgacgaagagaaatcaagtgatgacaagaaattggaggaacagcaagccatgacggagcagctggcgaaggaaaaaggaatcagcacctttatagaggtcctaacagcattcaacactaatggcctcatcggctatcgcaactctgaatccgtgaagtcaaagggggtacccgttcctaccagagatattatcagcaatgagattgacgtgctgcttcagacacagaaacaattttaccaggagatcctgagtgatgaatactgtgacaggatagtctctgccattttgttcgagaacgaaaagatcgtgccagaggctggatgctgtccctattttcctgatgagaaaaagctcccacggtgccatttcctgaatgaggagcgacgcttatgggaagccattaacaatgcaagaatcaaaatgccgatgcaggagggtgctgccaagaggtaccaatccgcgagcttttcggacgaacagcggcacatcctgttccatattgcccgctctggcaccgacataactcccaaactcgtgcagaaggagtttcctgcacttaagacatccatcattgtcctgcaggggaaagaaaaggctatccagaaaatagccggattcagattcaggcgtttggaggagaagtcattttggaaacggctaagtgaagaacaaaaggatgacttctttagcgcttggaccaacacgccagatgacaagcgactgtccaaatatctcatgaagcacttgcttctgactgaaaatgaggttgtggatgccttgaaaaccgtatctctcattggcgactacggtcccatcgggaagacagcaactcagctgttaatgaaacacctggaggatggactaacctatacagaagccctcgagagaggcatggaaaccggcgagttccaggaactgagcgtgtgggagcaacagtcacttttgccttactatgggcagatcctgacgggaagtactcaggctctcatgggtaagtactggcattccgcgtttaaggagaaaagggacagcgaaggcttctttaagccaaacacaaactctgatgaggaaaaatacgggcgcattgcaaatcccgtcgtgcaccaaaccctgaacgagcttcggaagctgatgaatgaattgatcactattctcggagccaaaccgcaggagataacagttgagctggctagagaattaaaggtgggcgccgagaagagggaagacatcattaaacagcagaccaagcaagagaaagaagcagtcctggcctattcaaagtactgtgagcctaacaatctagataaacgctatatcgagcgattccggctcctggaagaccaggcttttgtgtgcccctactgtcttgagcatatcagtgtagccgacattgcagcgggtcgtgctgatgttgaccacatattcccaagagatgacacggccgataacagctatgggaataaggtggtcgcacacaggcagtgcaacgacatcaaaggcaagcgcaccccttacgccgctttttccaatacatctgcctggggacccattatgcattatttggatgaaactccaggcatgtggcggaagagaaggaaattcgagaccaacgaggaagagtacgcaaagtacctgcaatcgaaagggtttgtgagccgattcgaatccgacaattcatatatcgctaaggccgcgaaagagtacctccgctgtctgttcaaccccaataacgtcacagccgtgggaagtttaaagggtatggaaacttctattctgcggaaggcttggaatcttcagggcatcgatgacttgctcgggagcagacactggtccaaagatgcagacacctcacctacaatgaggaagaaccgtgatgacaaccgccatcacggactggacgccatagttgctctatattgcagccggtctctggtgcagatgatcaataccatgtccgagcagggcaaaagagccgtagagattgaagcaatgatcccaattccgggttacgcgagtgagcccaacctcagctttgaagcccaaagggagctgttccgaaagaaaatccttgaatttatggatttgcatgctttcgtctctatgaagactgacaatgatgccaacggggcactgttaaaggacacggtgtattccatactcggcgctgatacacagggagaggacctggtttttgtggtcaaaaagaaaattaaggatatcggcgtgaaaattggggactacgaggaagtagcctcagcaatccggggacgcataaccgataagcagcctaagtggtatccaatggagatgaaagacaagatcgaacagcttcaaagtaaaaatgaggccgctctgcagaagtacaaagaaagcctggtgcaggcggccgcagttctcgaggagtcgaacagaaagctgattgaatccggtaaaaagcccatccagctatctgagaagactattagcaaaaaggctctggaactcgtcggcgggtactattacctgatctcaaataacaaaaggaccaagacattcgtggtgaaagagcctagtaatgaggtcaagggatttgccttcgataccggctccaacctttgtttggacttttatcacgatgcccaaggtaagctgtgcggggaaataattcggaaaatccaggctatgaatccatcttacaagcccgcatatatgaaacagggctacagcttatatgttcgactctaccaaggagacgtgtgcgagctgagagcctccgaccttactgaagcggagtcaaacctggctaagacaacgcacgtgcgcctaccgaatgccaaacctggcaggaccttcgtaatcattatcacttttacagaaatggggagcggataccagatttatttcagtaacctcgcaaagtctaagaaaggccaggatacctcctttacactgactaccataaagaattacgacgtccgtaaagtgcagttgagctcggccggtctggttcggtatgtgtcaccattactcgtcgataagatcgagaaagacgaggtggctctgtgtggggaatga

SEQ ID NO: 2874 - RNA, 3567 nt, synthetic construct
  misc_feature 1..3567: note = Cas9 variant
  source 1..3567: mol_type = other RNA
atgaagtacatcctgggcctcgacattggggtgagctccgtcggaatagccgttatctctgaggaaaaccagaaaaagaccattgagaatcttgctgtgagaatcgtacccgaagatcctgacttccacggtaaattttattcaggcaacacagcaagtaagaatctggagaggactgccaaacgggggaaccgcaagaataaccaacgattcaaggcgcgtagagataaattgtaccagagcttaaaggaaaataacatgtttccaacgtccaatctgttcgacctatctgctgtggagctctatggactgagggccaaagcagtctcggaacaggtgtcacttcaggaactgggccggattttgatcctcctgaaccaacgcagaggttttctgagcaataggaagagtgtttccgaggaaaactctaccgagtacaaagagcggatagccgggctcgaaaaggctttaggaaataagacaatcggccagaaactgtatagcgagcttcaggaaaacaataacgtgttcgaggtcttgctgcgcgaacgaacttaccagagatcctcatataccgaggagtttgataggatttgggacgaacaaaagaaatactacctaatcctcacaggcagtagcaacgaggatgacaataaggggaccctgtatgatcttattcggaaccgtatcatatactatcagcgcccgctgaaatctcagaagggattgatttccgaatgcctcttcgagaaacatcacaaggcagtggccaagtcaagcccctactttgaactgttcagaatctggcagaaaattaatgacttaagttggaagactcctaacggtgagctgtttaaaccaacagatgagcaaaagcagaaactcaagaatgctctttggaacggcgacaatctgaaccccaagcataaattgaccgtatctaagatcaaagaaatcctagggtatacgtccagggagaagatttacctgaatttcactgaactcgatggaagccggacctattcgatactgcgaaacgcccttatcgaggcgggcattgaaaaacctgagcagtacctgtttttcaatatggagacaaacgacgaaaagggtgggttgttcgagctctggcacatcacttactctctgccaatagaaaaggaggttattaatgcattaaagaaccgctttggattcgacaagaaacaagccgagatcatcgctagaagggtgggctattcctcagattacggcagtctgagcacccgggccattcgcaagctactcgtccatctggaaaaagggcttggatatacagacgcatgtgataatatcggttacgaccactccggctataagaccaagattgatttgcagcccaaactgaagcagctcaaaagaaacgagctgaggaaccctgtggtggaacagatacttaatcaagtcgttaacgctgtgaatctgatcattgagaagtacgggaaaatcgacgaaatccgtgtagagttggcccgggagctccgaaacaatgcgaagacgaggaaaaacatttctctgttaaatagcaagaacaagaaaaataacgatataatcagaaagaaactgcaggaagagtatggatttaagttcgtgaatggccgcgacgtcactcggtacattctatgggaagagaactcaaaagaatgcctctactgtaataagacaatcaacggtagtgatatgctgaccgggaatgccgacattgagcacatccttccaaagtccaggagctttaacaacgcaatgaataactatataatcactcatagaaaatgcaattctgataagggccagaaaacagcttacgacttcatgtcaagtaagggagaggtgattttgcagcaatatatcgaaaaagttaacgacctgtacaaggatggcaaggggagcatttccaaaaccaagtttgagaatctcctgtgtaaaggagaagacatcccgtctgatttcgtggagcgcatgaagaaagactcgcagtatatagccaaggaagctgtcaagatgttaaaaacggtgtgccccaacgtatacaccacaactggtcaggttaccgattttctgcgagaggagtggaaacttaaaaatttgctccaggaactgacattcgagaagtataaagccattggccaagtgaaggagaaaatcattaagactaacaatgggcagaccaagacatttaaagtcatcgcagactggagcaagcgggatgaccaccgtcatcacgccatagatgctctaatctgtgcgctgaccgaccagaaaattatcttcaagctcaacaatctgaacaaaatttaccagtacgagagaaatgcactttcccaaaaggagatcgaagagatagaagagtttttggaaggaaagttctcaattaaagagttcagtgcccagcagggcaacatcatcgagtgctctattcctaatatcaggaaggatgctcaaaaacacctggaaaacattttaattagctttaagaaagagaactccaaggtgctcactatgaatcgcaaccagccaaagaattgtaaagaacagatcacgtgggtcccccgggccagactgcatgaggacacaattatgggtagggtgaagcgaatccctgagaaaaagatgaaacttaacgataaggtttcattcgaacagattaagatgatcgtgaatccagagataaaagaaatcctgttgtatcgcctcgcaaagtttggggacaaccccaaagtagccttcgctaccaaggccctgaaaaaggagccgatattttaccgggaaaatgagctaaaggaagtcagcatctatgagtgggtgaacactaaaagagttgcactgaatgagaacattaccgactctcaaatcgaaaagataattgatcaggcgtccaaaagggctgtgaaggagcgtctcaatggcggaaaaatcaaggaagtcttcaaaaacctgacagagaatcctatccagcttaagaacggcatgattttgaagaatgtgaccgtaactgacgagagtaaagtggaaaagatacgcaacgggtttgccatcacaggtaaaaatcaccatgcactggtttacaaggatgagaacggaaaatataacgacaaggtcgtgagcttctgggaagccgtggctattggcttacggaatgtcacggagtacgggaacccctatccaatcattaatagaaaccacaatgatgaactcggagagttttacttctctatgcagatcaacgacctgtttgttttcgatcttaagcattccgagaatcctcaagaagagaacgaaataaactttttcgacgtggagaataggaaacagatctcagataagctgttccgagtgcagaaaatgagtaagaaaagcaatggccagtttgtatcggacttccggcaccacctagaaacctccgtcattcgcaacgatatgatcctcaagaatattacttggatctctataagcaagaactcagacctggagagattgacaaaaattagggtgaatcatctgggtgagatcatcaaggttggggaatga

SEQ ID NO: 2875 - RNA, 3585 nt, synthetic construct
  misc_feature 1..3585: note = Cas9 variant
  source 1..3585: mol_type = other RNA
atggacttcaccgccgatgtgagcgagctgaacgaatcctttatgcagatccacacagagtctaagttcgaaattgacactgctaaagtccaagagatatcacagctccttctggataataagatcacgagaatggacaggcagaaacaggttgcaaacgtgttggccaagaatagtggcgataaagaagcggacaagattaacaagaaaatcgctaccgagttttgcaaggccgtattagggaataaagcaaagttcaacgtgattctgggagaggatgccgtcgacagcgattggtcctttaaaatggacgatgaaaattctgacgaggaaatcgagatactaatgggtcaaacaaacggccagcagcagaatgtgctccggatcattcatcaatggtactcgcagatcactctgaacgggattgttcccgatggacagatgatctcagagagcatgatagacaagtatgaacttcaccgcaagcatctgttgctcctgaaacagcaaattaaggtgaccaaagacaagaaaaaggctcagcagctgcacgaggcatacgaacaatatgtccatggcacaggtgccaaaaagaagctcacccaggatgacttctacagtaaagtgactaagaatttagagacatccgatttttctgacgaaatcaaaaagcagattaacgctgagaccttcatgcctaaacagcgaacgagcgccaatggggtaatcccacaccaactgcaccagcaggagcttgataagatcattgaaaagcaggcgaaatattacccgtttttggcagagctgaaccccgacactaagcgtcaaaatatagccaaatataagctagatgaactcatcgctttcaaaattccttactacgttggaccactgatcaccacagaggaccagaagaagacttccggcaaatcatttgcctggatggtgagaaaggaacccggcaaaataaccccttggaacttcgatcagaaggtcgacaaaatggcaagtgctgatcagtttattaggcggatgacaaccaaggacagctatcttatcacggaggacgtgctgccagccgagtctttgatctaccaaaagtataaagtgctcaacgaactgaatatgattcgcgtcaacgggaataagttaactaaacatgataagcagaacatctaccagcaggttttcgagaaatataagacagtgaatgtaaagaaggtgcaaaactacttcctgaccgacggaagatatcagcacgcgcccaagattactggtctctccgatgacaataaatttaactcaaatcttagcacatacatagatttcaagaaaatctttcaggacgtcgtggatgaccctcaaaagcagaaagatttcgaaaggattatcgagtggagtaccatctttgaagaccggcatatttacgaggttaagctgaaggagatatcttggttgaacgatgaacagcgcaaagagctaaagaaaaagcgacaccagggctgggggagactgtccgccaaactcctgacgggaatcttcgacgaaaatggctatagcattatggatcaactttggaacacccagaagaattttatgcagatccaggcagaggagggtttcaacaagaaaattcaagctgaaaattcgaagcacctggagaaaaacgactttgaagacatcttggaggatgcctacacatctccacagaacaagaaagctataaggcaagtgatcaaggtcgtggaagacattcagaagactatggggaccgccccgcagaaaatctccattgagttcacacggtcagcagataagaatccccgtcgcagtatcgagagacagaggcagctcgaagagatatattacaacgacgccaaagaaattgtaagcgagggaatgcaagataatctgcagaactttactgacaataagcagaccttaacagataaatatttcctgtactttacccagctaggcatcgacatgtatactggcaagaaaattaacatcgatgaaatagggaattaccaaatcgaccatattctccctcaggctttcatcaaggatgactccattgataacaaggttctggtgtctagcgcgatcaataacggaaaatcagacaatgtcccacttagtatgtacgcatccgtgcggataaagagcgaggtccagaacaaatggaagaatttcgccgagcacggtttgatttctcagcgaaaactgaacaatctcatgacggaccccgaatcaatcgataagtataaggctcgcggctttatcaaaagacaactggtggagacaagtcaggttattaggcttgtggccgaaatcctgaacgagaagtaccagggggaaaccgagattatagaggtacgggcaaaaatgaacagccagttgcgcaaggacttcgatctcctgaaaaatagaaacgtcaatgactatcatcacgccttagatgcttacctgactacctttatcggaaactatctatacaggcgttatcctaagctccggtcctacttcacatacggccattttaagaaaattgacgatgccaagctgaaacaattcaattttcttcacgacatcgaaaacgataaggacccaaaatatgtgaatgataacggtgagttgctgtgggaccgagaaaaggacattgcatacttcaagaaaatctataattttaagtacatgctcgtttctcacgaggtgtcgaccagacagggggcgatgttcaaacagactatatttcccgctgccgcagatgccaagagcaaactgatcccgattaagaacgacaagcctacagctatctatggcggatacacgaataacaatgatgcctatttagcaattatcaaactggctaagaccggccagttcaaagtcgtgggggtaccccaaagggccatagtgaaacttaaacaggcgtacgacaaggagactggagattactccaacgttttgtataaagtcctcgaaccaaagtttgtgaagaaaaaggtgaatcgcaaaacaggtgagattacctaccaggtcgaaaagttcaaaatcgttgtgcctaaggtgccctatcggcaactggtaatcgacggcgatcagaagttcatgctagggtcaagtacatacaaatataacgccaagcagctggtcctctctgagaacgctattaaaatactggacaagaaatcctttgatcagagcggatacaagtcaagcgaccttgatactgtgtatgacgaaatcttgtctcaagttgatagatacttctccatgtacgacaagaataaatttagggagggcctgcataacggtaagaaatatttccagcgcttaccaatgattgacaatgtggagaaggggaaaatcaaggaaaacggcaagtttaaactcctgaatgagattcttatcggactgcacgcaaaccccagtttcggcaatctcaagagcttggggatatctaccccttttggaatgatgcagttcgcctccggtatctcactgagtgaaaacgctattctatgttaccagagcccaacgggcatctttgagcgacgggtcgccctgaaagatctctga

SEQ ID NO: 2876 - RNA, 3588 nt, synthetic construct
  misc_feature 1..3588: note = Cas9 variant
  source 1..3588: mol_type = other RNA
atgcagaagaacatcaataccaaacaaaaccacatttacataaagcaggcccagaaaatcaaggagaaactgggcgacaagccctatagaattgggctcgatcttggagtgggtagcatcggcttcgctattgtctccatggaagagaatgacgggaacgttctgttgcctaaggaaatcataatggtgggatctaggatctttaaagcatcagccggcgcggctgatcggaagttaagtcgcggtcagcgaaataaccatcgtcacacaagagagaggatgcggtacctgtggaaagtactagccgaacaaaagctcgcactgccagtgccggccgaccttgatcgcaaagagaatagctccgagggggaaacttctgctaagagattcctgggagacgtcttgcagaaggatatttatgagctcagggtgaaatcgctggacgaacggctgtcactccaggagttaggctacgttctgtatcatatcgcaggccaccgcgggagcagtgccattcgaacgtttgagaacgattccgaagaggctcagaaggaaaataccgagaacaaaaagatcgccggaaatataaaaagacttatggcgaagaaaaactacaggacatatggtgaatacttgtacaaggagttctttgagaataaggaaaaacataagcgggagaaaatttctaacgcagccaataaccacaagttcagccccactcgtgacctggtgatcaaagaagctgaggccattctaaagaagcaagcaggcaaagatgggtttcacaaggaactcaccgaggagtatatcgaaaaactgacaaaggctatcggatacgagtccgaaaaacttattcctgagtcaggcttctgcccatatctgaaggacgaaaagcgcttgcccgccagtcataaactcaacgaggagagaaggctgtgggaaaccttaaataacgcgcggtacagcgatcctatagtcgacatcgtgactggtgagattacagggtattacgaaaagcagtttaccaaagagcagaagcagaaactgttcgactatctccttacgggatctgagctgactccagcccaaaccaagaagttgctaggcctgaaaaatacaaactttgaagatatcatactccagggccgagacaagaaagcacagaagattaaagggtacaagctgatcaaacttgagtccatgcccttctgggctcgcctgtcagaagcccaacaggatagctttttgtacgactggaatagttgtcctgatgagaagctcctgactgaaaagttatctaacgagtatcacctgaccgaggaagagatcgacaatgctttcaacgaaattgtactatccagctcgtacgccccactcggaaaatctgcaatgctgatcattcttgagaagataaagaatgatttgtcctatacagaagccgttgaggaggctctgaaggaaggtaaactcaccaaggagaagcaggcgatcaaagacagactgccgtactatggcgcagtgcttcaggaatcaacgcaaaagattatcgccaaagggttcagtccccagtttaaggataaaggatacaagactcctcatacaaacaagtatgagctggaatacggcaggatcgctaatccagtcgtgcaccagaccttgaacgagctccggaaactggtgaatgagattatagacatcttaggtaagaaaccctgcgaaattgggctggagactgcccgcgaactaaagaaaagcgcagaggatagatccaagctctctagggagcagaacgacaatgaaagcaaccgtaaccggatctacgagatttatatccgacctcaacagcaggtcataatcacaagaagggaaaatccacgcaactacattctgaagttcgagcttttggaagaacagaaatcacaatgtcccttttgcggcggacagatcagtccgaatgacattatcaacaatcaggccgatatagagcacctgttccctattgctgaatccgaggacaacggccggaataacctcgttatcagccattctgcctgtaatgcagataaggcgaaaagatcaccctgggctgcctttgcaagtgccgctaaggacagcaaatatgattacaacaggattctgtccaatgtgaaggaaaacatcccacacaaagcctggcgcttcaatcagggggcatttgagaagttcatagaaaacaagcctatggctgcccgatttaaaaccgacaattcttatatctcgaaggtagcgcataaatacttagcctgcctgttcgagaagcccaacattatctgtgtgaaaggaagccttacggctcaattgcggatggcatggggtctccagggcctgatgattccatttgccaagcagctaatcaccgagaaggaatccgagtcattcaacaaagatgtcaatagtaacaagaaaatacgtctggacaatagacaccatgctctcgatgccattgtgatcgcatatgcgtctagggggtacggaaacctgcttaataagatggccggcaaagactacaagatcaactatagcgaacgcaattggttgtccaagattctgttaccccctaacaatatcgtttgggagaacattgatgctgacctcgaatcatttgagagctctgtgaaaacagccctgaagaatgcattcatatccgtcaaacacgatcacagtgacaacggtgagcttgtgaaggggactatgtacaaaatcttctatagcgaacggggctacaccctgacaacttataagaagttgtctgctctcaaactgaccgacccacaaaagaaaaagacaccgaaagattttctagagaccgccctgctcaagttcaagggaagagaatccgagatgaaaaatgagaagattaaatcagcaatcgaaaacaataagaggctgtttgacgtaattcaggataaccttgagaaagccaagaaattgctggaagaggaaaacgagaagagtaaggctgagggcaaaaaggagaaaaatatcaacgacgcgagcatataccagaaggccatctcgttatccggggataaatatgttcagctctctaagaaggagcccggaaaattctttgcaattagcaagcctactccaacgacaaccggttacggctacgacactggggattcactgtgcgtggacctttattacgataataaaggaaagctgtgtggcgaaatcattcgaaaaatcgacgctcaacagaagaaccccctaaagtataaagagcagggtttcaccctctttgaacgcatatacgggggcgatattctggaggtcgacttcgatatccatagtgacaaaaattcctttcggaacaatacaggatctgcccctgagaacagagtgttcatcaaagtcggcacctttactgaaattacaaataacaatatacagatctggttcgggaacattatcaagagcacgggaggccaagacgattcctttaccattaattcaatgcagcagtataacccaaggaaattgatcctgagcagttgcggtttcataaagtaccgttctcccatcttaaagaataaagaggggtga

SEQ ID NO: 2877 - RNA, 3594 nt, synthetic construct
  misc_feature 1..3594: note = Cas9 variant
  source 1..3594: mol_type = other RNA
atgagcaagcacgtgctgggcctcgaccttggggtcggatccatcggttggtgcctgattgccttggatgagcaggaccaacccgctgaaatattaggcatggggtctagaatcgttcctctgaccacagatgacctaaacgagttctcacagggaaaagcaattagtaagaatcagaaaaggactacgcagcggaccatccgcaagggcctcgatcgataccaactgcgtagaaaagtgcttagcgaaaagctggccggtcatgggatgttgccagacaaggatctcatgcagctgccggtactggacctctgggagttaagggcgcgggctgcctcccccggagaaaaactgtctcttcctgagattggccgcgtgttgtatcacatcaaccagaagagaggctacaaacatgcaaagtcggatgaggccgaagaggtcacaaaaagggggaaggaacagggatatgtggctactgttaagggtcggtacgcagagctgcaacgcgagggcgccaccgtggggcagcactttgcttgtaaactaaaggaacatcgacaggagtcaccaagcggaggcttcttttataattacagaataaaagaccaggtctatcccagggaagcctacatcgaggagttcgatcggattatggaagtgcaaagtgtattttaccctgaggttctcacaccagcgttcatccaggaactgcgtgacaaggtgatctttttccagcgcccccttaaatcctgcaagggtctggtctctttttgtgagttcgaaaaacaagagagagtggtgcagttgaagagggtcaaccgggaagggaaggaggagctccaggaacgaaaaattaccataggacctaaggttgcaccaaaaagctccccgattgcccagctgtgcaagttatgggagtcaatccacaatattcgcatctattaccccgatggcaaagaaagacctatcactctggaggaaaagaggaagctccttgcttatctgcaaacacacgacaaattgacctttacggccctaaagaaagagctgaagattagtgacaaagagcggctctggtgtgataagctgcttaagggcgggataaaaggagacactacccgcgtgctgttgagaaaggcactcgctggttacaaaaggtatgaaccactgttacgtatggatctggagctacgggacttccaggaaatcgtaagcggcaagcgactcattagacccatcgtggatgagtcttacctgtcccagcctctttataggttgtggcatatactgtactcaattgaggaacgcgaggccatgcggagagcgctcatcgaccagctggggtttcttgaagaggatctggacggaggcttgctcgataaactgtaccaaatcgacttcgccaagcagggttatagcaacaagagtgcaaaattcatttgcaagttactgccacacctacaagggggccatggatactctcaggcttgtgaactcgccggcaaaaggcactccgctgggagcctgacaaaggaggagcttgaggaacgccccttgctggaacacatcccgctcctgcagtgcaatgagttacgacagcctattgtcgaaaagatactgaaccagatgatcaatcttgtgaacgccttgcggcagaagtatggatcgattgatgaggttcgtgtggagctcgcaagagaactgaaaatgtctagggaggaacgcgaggaaacttccaagcggatcagatcaagggagaaggagaataaagaaatcgccgagcgaattaaggaatacgagctatatcccaccaaaagtcgcatacaaaagtaccggctgtggcaggaggctggtgaacagtgtctctattgcggcagaagcatcgacgtcgtgcaatttctgcgtggggacggagtagagattgaacatatcattccaaaatccatcctttacgatgactctagcgcgaacaagacatgtgcatgctcaaggtgcaataaggataaaggcaaccgcaccgcctacgagtatatattggctgaaggtcgggaggccgagtacctggacagattagaaactctcttccacgatgggaagctgagttattccaaaaggcgacggcttcagtggaagaaagcagacatccctgttgattttattgagcgccagctgagattgacgcagtacatcgccaggcaagctcaggaaattctccggcagggcatccgaagagtgggagccagcgagggctctgtcacagcaaagctgcgccatctatgggggtatgacgatatactgagggaactcaatttcgagcgttaccagtcaatgggagagaccgaaattgtgagtcaagaggaaaaggacggtagcatcactaaatccgagcggattaaggattggtctaaaagaaaggaccacaggcatcacgcgatcgatgctctggtcgtggcctgtacacgccagggctatatacagcgacttaactcgttgaacagcgaagaggactccctgcagatgcaagaggactcaaaacagatgagagaaaagatgggagggcagaagcggcccaccgcagataaacacagtatcttagagaattggctcattctgcaaccacatttttctcaccaggaagttaagagcaaagtggccgagatccttgtatccttcaggcccggcaagcgcacggtctcaaccggtcgtaacacatacctgagaagcgggaaaaaggtgactcagtctggcgttctaattcctcggggaccactctccgaggaaagtctgtacggccagatcttgaggaatggggagccgacctatgtgaaaaaggtcgctctggagagcttatctgaagcccaaatagaacagattgtggaccccaagctccgccgagagatggtagcaagaacacagccttccgagggagctaaactgaacccaaaacttctgttggccactcccttttactcagatgcggccggcacccagcgggtgaggagtgttcgcgtcgctatcgaaaatggtaaaaacagcatcgtgcctctcagatataatgagtcggggaaggcaattacattcgtgaacccaggaaataaccatcacgtcggcatctacaggacctccgaaggtaaactggttgagtcttgcgtgactttttggcaagccgtggaccgggtacgttatggcattcccacgataatccgcaagccgcgagaagtcctagatcagctgcttctcagagacgatattcctgaggctctgttggcccatctgccagcaagcgactgggagttcgtggaatacttacaggcgaatgagatgtttctcatcgggctgacagatgaagagattcagaccgcccttgctgaatcagacctgttgactctcagtaaccacctgtatagggttcaaaagatgtcctctgagtactacgtgttccggtatcacctagagaccgaagtcgccgataataaaaacaatacaggaatcatacccaagttttaccgcctgagaggccctaacgacacctatcttaaagcaaaccccaggaaggtgaaagttaatctcctgggggagatcagcttgccatga

SEQ ID NO: 2878 - RNA, 3615 nt, synthetic construct
  misc_feature 1..3615: note = Cas9 variant
  source 1..3615: mol_type = other RNA
atggagagaatcctgggcattgacaccgggacaaacagcctcggatgggccatagtggataaggacgaaaatcagtaccaccttgtcgctaaaggtactaacatcttctccgagggcgttaagattgaaaaagggatcgagtcttcaaaggcagccgaaaggacggagcatcggagtgtgcgcaaacactattggcgacgtaagattagaaagatcaggctgttgaccatattaagcgataatgacctgtgcccccggctaaaacatgagcaactccgccagtggagactgaagaaagtataccctacagatgacacttttatggaatggcagaggaccgaggataaggctcaggtgaacccatataaattccggtacatctgtcttacacaaaagctggacttgtccgatattacccagcgctttatcctcggacgagcgctgtatcacctgaatcagagaaggggcttcctctctaaccggaaggaagccactaaagagtcggagggtacagtcaaggaagggatttcaagcctgagtaaagacatgaaggattccggatgcgagtacctgggcgaatatttttaccagctttaccaacagggcaaaaagatccgtaatcattataccgcacgcaaagagcactacttgaaggagttcaaggccatatgttctaaacaggaactggacgatgctctaattgagaagctcgaaaaagcaatctttgaccagagaccgttaaagagccaaaaaggacaggtggggacgtgcactttcgagaagggtaagtccaggtgtccctcaagtcaccctctttatgaagactttcggatgtacagcttcattaacaatatcaaagttcaggtggataccctgtatgacaagggcgagcgatctttgacagatgaagagaaacaactcatcattccactgtttaagcgcaaatccaagagaactttcccctttgaggacatagccaagaaaatcgctgggaagaacaattactgctatattaaatcaaacgaagagaaggcctacaaattcaattaccagatggatacccaggtcagcggaagtcctgtgaacgcgcagttagaagagatcttcggcgaagactggctgtcttccgtatgtgaggtttatacactcgcaaataacaagagcaggtttcaaataatgaacgatgtgtggcatgtccttttcttttacgacgatgaggacaagctgaaagagttcgccaaggatcggttgcagctagacgacgaactggctgaaaaattttcgaagatttctatcccaaatgattatgccgcactctccctgaaagctatccgcaagattatgccctaccttagagactatggtctgatctactcagaggccgtgttcttggcgaacctcgtggatgtcctgcctcagcacgtttgggggattaaagagatgagggaagccgcaatagagaatgtgatcgacgtaatgcatagttatgataagaacaatattgacggaatcaccttagaaggctgcgtgaagacgtttctgaaagagcgttaccaggtcagcgatgacaacctaaagaaactctaccacccatccatgctggatccgtatccccggcaacgacctaatgacgaaggcgtgttccagcttgggtctccaagaatcagctcagttaagaaccccatggctatgcacagtttgtttaggctgcgcaaagtggtcaatctcatgctgaagaagggatacattactcctgatacaaaagtgcatatagagttctcccgggaccttaacgatgccaataagagatgggctatccagacctggcagagggagaacgaaaaagagcgcgaacgatgtcggaaggagattgaaaaatatatcgccagcccatctgacactgacattctgaagtaccaattgtgggaggagcagaatcacaagtgcctctatacaggtgatgaaatccgtataaccgactttctgggcgataaccccaaatacgacatcgagcatacgattccgagatcagcagggggagatagtaccaagatgaatttaacactgtgtagctccaggttcaaccgcgacgaaaagaagactaaactacctgccgagctcgtaaaccacgatgaaatcctggagcggatttctaattggaaggagaagtatgaagacatcgataaacagataagaaagatttcgaccaaaggcgctacaagcaaggaggacaaagattccaagatcaggcgacgccattaccttattttgcagcgggactactggagaggtaaatatcaaaggtttactatgaccgaagttcccgaggggttctcacgtcgccagggcacagatatcagtgtgatatctcggtacgcgagaatgtatctcaagagcgtcttcaaacaggtgtacatcgtcaaaggaattgcaacctccgactttaggaagatgtggggcatccaagacgagtatgccaaaaaggaacgagtgaaccacgttcaccattgcattgatgctatcactatagcctgcattgggaaagcagagtacgacaagctggccgattatcggcaccagtacgacgattacctgttccagggaaagacgaaaccaacatttgacaagccttggccctcattcgtgatcgatatcaaacatattcaggacgaattactgatcgctcactatgccaaggataatcttgagaaatttaccaagaagaacttgcgcggtaaagacggcagaattataagggataagttcgggaataaactccaaatgaagggagacactagccggaactctctgcacaatgacaaattttacggcgcaatcaaccatgaaggtgagattaagtatgtataccgaaccaatatcgaggcgctagatgctaagtccattgggaacatcgtcgacccaacagtgagaagtataatcgaaagcgccattgcaatccacggctctctgaaagccgctattaataagggaatctggatgaacgaggaaaaacatatacccattaagaaagttcgcgtgttcaggaatgatgtcaagaagcctatcgagctcaaagaccagcgtgatctgtccgacaaggattataaacagcactactatgtgaccaacgacggcaattacatgatgcttatcttttcaaagttgaacaacaaagggcgggaaattagacagcatgtagtgataaatagtctggaggccactgaggttatcaagagccacaaaaggtcgcaagtcggaaaggtggtgtgggaatcctactattctaaggagggtttcgatttaatttacaaactcaagagcggcacaatgatcctgctttatgaaaacaatcgcgacgaggtctgggatctggacattcgaaacttgcagaaaagactctacatcataacgaagatgaaatatgatgggcggatctacatgatgcaccatcaggaagcaagggagaagaaggacctggaggaaaaatcaggaagttttaagattaatgaggactatcgcccactaatcgttaactcctacaatcagttcaacgctctggtgcaagatctcgactttgaaattaatgatctgggcgagatccgtagacttatatga

SEQ ID NO: 2879 - RNA, 3630 nt, synthetic construct
  misc_feature 1..3630: note = Cas9 variant
  source 1..3630: mol_type = other RNA
atgaagaaagactacatcctgggcctcgatattgggataagctccgtgggatggggtcttctggagttggacgataacaataacccctataagatcattgacgtcggctctagaatcttcacccctggggaagttgagaaaacaggagattcaagggccaaggaacggcgcgagaaacgaggcgctcgtagaattgcaaggcggcgcgaatttagattagacagggtgaagaatctgctatacgagaacggttatctcaaggggaatatcaacagtaatatagtaagcgagaaaaacgaagaactgtccatcattttcaataacatgatcaataactactataatggaaagaacactaatccatacattcttaaagtggaagccctggatcggaagttgacggacgaggagctctctatcatactggtccactatgcgaaaaagcgcggctacaagtcgaaccgagaagaggcttcagataaagaaagcggcaaggtgctgaccgccattaaagagaacgaaaagatcatgaaagacaataactacagaacaattagtgagatgtatatcaaggatgacaaatttaagaataagatcaaaaactccccgaatgattacaagatttctgttactaacgagatgtatctcgaagagataaataaagtgttagacagccagatcaagttcgggctgattaccgacgattttaaaaaccaataccttgaaatctataattccaggcggtcatacgcaaagggacccggtggcaacagtccttatgggggagacttgatagagcgtatgacaggcaagtgcaatttcgatggtaacccacgcgcccccaaaagagcttttagctctgaaatttacgtcgcactgaccaagctagtgaatctcaaatacaaggtaaacgacggggagtatatcaaactgtccgagaaggaaatcaagaatattatcgagaaagccaaggaaaagaagtcaattagctacaaagatcttactaagatgataggaaacaacatcgacttcaaggatctgacattgagtaaaaaggagtatattaaactcatcgaggagctgaagaaaaagttaaatatcaaaaaggacaccaagattaacataaatgagctgtcttccgaagataaagagctctacaacaaactttgtaatgacaaactgttgagcaagacgctaatcgaactgaaaggctatcatattctcaaggattcggttatcaaggcttactctaaagacatttgggacgaggtgaaggataacatgtatctgcttgacgatctggccttgtactgcactaattacaaagtcaacgaggacatcctcaataagataaaagaatccgagaacatcgataatatttttaacgacatccacttcgtggaactgttacctaattttaaggatcatctgatgctatcaaccgagctcattaggaagctgatcccaataatgtatggcgggaacacatacgacaaagcgatgaatattcttggatataaccacagtgatatcaacggtgacaaggaaaagaaggatttgctggtgcccatttgtgtcgacgataatatcactaaccagcgggttatacgaagcctcacccagacacgcaaagtgatcaattccattatcaagaagtacggcatgcctaaaattatcaacatagagaccgcaagagagctggccaagtctaggcaggaacggaatgagattgctaaaaacaatgtagaaaagcaagccgagaacgagaaaatcaagaatcagcttgtggaactggggttgttcgtcagcacggacaaaatctcaagtactgacctcctgaagtataagttatggaaagagcagaacgaattttgcggatactccatgaagaaaattagcatcgaggatctgttcggcaataacattgtgcagatagaccatatcctaccatattctcgcacatacaatgataactacctcaataagaccctggtttatactaaagaaaaccaagagaagggtaacagaacaccgtacgaatggttcgggaagaccgacaaatgggatgagtatgagacgtacattaataaccttaccatctcacagaagaaaaaggacaattatttgctgaaaaagctcgattttgacacagaaagggagatgcgtagtcagaacctgaatgatactaagtacattagcaaagaattatcctctctgatcaaggcatatcttaacgtggagaaagtcaatatgtaccccggcgctataaccgccaagttgcgggcgcgatggggattcaacagactcacacactcgtacctgagcaaaaattatatcctacctaagaacattaaggaggacatcaataaagatagggacaaccatctgcaccacgccatggatgcactcgtgattgcttccatcactccatcactgcagcaaaagataaccctttacgaaaaatttagtcgctatattgacggcttgacagagctgcagatcaagaatatctcttacattaaaatagaagacagcgaggggcagtattacaacgatgacaccgatgaagtagagactatcgacattcgggagtatatcaagcaacagttagccgaaaataacatttactacaatagacataacatctccaagctcgagttccccctgccttatgaaaactttgataaagaggctaaacttagggtttacgaacaggacctggatacgttgaaatggaatctcaagtcatataacacatacacccagaaagacatagataatgtgcacactctgatcccaagcattgccaagaccaaagtctctggaaagatgcacgaggagacatattacggtatcaaggaaattggcaaagacgaggataagaaaatctataagaccctacgcactcccatagaaaaagtgaagcgaaaggacctggacaacattccggatcggctcgggggatccaaagacgtctacgagagtctggtggaatggttcggcgattacgaggttggtgaggaagtgcttaaggcaaatgggaacaaatatcctgtaagcaagtctgacaaagagcataaggaaatcaagaaattgaagctgtactccgagtataaaaatacaggccacatgatcaacaagtcaaatgtcgagaaaggaggcatttaccgtatcgatgtgtttaagagtaaggacaaagaagatgacaagttatatttcgccgcttacgatatactcgagattaaaaagatcaacacgctgaaagaaaagaatagagttgacgataactttaatattaaacttgactatgggcaaggaaagaacagcaagatcatgtcgtacaccgatataattaataactacgacctgtatatctccctaaacaaaaatgacctcatcaagattactacaaacgatggtaaagagtctgtggcgtacgtcgtgggctgtagctcagggatgctggaagtaaagagtaaattgggagacggctatgatatcattaagaccgacctgaatgagaacaatatattctccaagcagagggcacagtaccagatcacagtgtctactattaaagagatcaagaaattaagcatctccgttctcggtgaaatttcagggctgtga

SEQ ID NO: 2880 - RNA, 3633 nt, synthetic construct
  misc_feature 1..3633: note = Cas9 variant
  source 1..3633: mol_type = other RNA
atgagaaccatcctgggcctcgaccttgggacaaacagcattggatgggccgtgataaattccgtcatcaaggagcagactgaaaggatttggatcgagatggctggttctcggattatccccatggatgcagccatactgggcgacttcgataaagggaactcaatcagtcaaacggcggaacgcacccgatttcgtggagttagaaggttgcgggagcgccagttactgagaagggaacggctacacaaggtgctcaaaattctgggcttccttcctgagcattacctgaagggtatcgactttgagaaacacacagggaagttcttgagcggatccgaaccaaagctcccgtgggtaaaagatcgctggggcaagtattcttttctgttccagactgcttttaatgagatgctggccgacttcgcaaaacatcagccctcgctcgtgtttgatggcaagaaaattccttacgactggaccgtctattacttacgaaagaaggccctgacagaaatgatctcaaaagaggagcttgcttggatattgctgaacttcaatcaaaagagagggtattaccagctaaggggagaagaggaagaggataacgcaggtaaaagcgtggaattttatgccctcaaggttctgagtgtggaggctaccgacgagaaaaagggccgggatatttggtacaatgtccaccttgaaaacgggtgggtgtaccgtcgctcctctaatgtaccactggactgggagggaagagttaaagaatttatcgtgactacagatttgaaccccgacggcacccctaagctcgacaagtatggtgaggtcaaaaggagctttcgggccccaaaggaagatgactggatgctgattaaaaagcgaacggaggcggatatcactgggacccataaaacaatcggatcctacatttatgacgcattactgcaggagccccagcaaaagataatcggcaagctcgtgaaaactgtggaacgcaagttctacaaagaggaacttaatttcattctgcagaagcagtgcgcctttcacgctgagttgcaggatagagacctatatatgaggtgtatcgaagccctgtaccctggcaacgaggtccaacggcgcaatatagcaaacagagatttcatttatctcctgatcgacgatgttcttttctaccagaggccactgaaaaccaagaagtcattgatcgctaattgcccgtacgaggaaaacgagtatgtgaaccgtaaaacaggggaaattaagaccgcccccttgaaatgtatcgcgaagagtcaccctctgttccaggagtttcggttatggtacttcctgagcaatattcgagtatatcaaaaagagagagaagtgaacggaacgctacatctcgacgtcgatgtgactacagagtttctgaagaccgaagacgactacgttgcccttttcgattggctcaattctaggaaggagatagaccagaaagcatttctgcgctatccagctttcggtctcaagaaagaaatcaacaattaccggtggaactatgtggaggataagttttacccctgcaatgagactagacacgccattctgtccaggcttgaaaaagctggcatcgggatcgacttcctgtcagatgagaaggaaacagccttgtggcatattctctacagcgtcagtgacaaacaggagatagaaaaggcactggccacctttgctgtgaagaacggattaaatgagtctttcgtagaggttttcaaaaagtttcctccattcaaatccgaatatggcgcgtacagcgcaaaggccatcaaaaagctgctacccctcatgcgctgtggtaagtattgggatatgtcgctgattgacgggacgaccaaagagcgaatcgaacggattatcgctggcgagtgcgatgaatctataggagccaaggtgcgtgagaaagcaatgaacctttccgacatctcatgttttaagagattgccgctgtggctcgcctgctacgtcgtgtataataggcacagtgaggataaagaaattacaaagtgggagactcctgctgacatcgatgcctacctggcagcgttcaagcagcacagcttacgcaaccccattgtcgaacaagtgatcaccgagacactgcgggttgtgagagacatatggaaacaggtaggcaagattgacgagatcaggattgaacttgggcgagagatgaaaaatccagctgataagcgcaaacggatgactacccagatcttggaaaacgagaatgccaacctcagaataaaggcactgctagccgaatttgtcaaccctgagtatggagtggagaatgttaggccctactccccatctcagcaagaaatcctgcgtatttacgaggacgctgtgctcaagggtgaggaacagatccccgaagatattgacgtcatcctgaaaaagttcaacacaagcaaacttcctaccaagtcagagtttttgcgctataaactgtggttagagcagaagtaccggagtccatatactggcgaactcataccgctggccaaacttttcacggcagcttacgagattgaacatgtgatcccccagtccagatattttgatgacagcttctctaataaggtaatctgtgagtcagccgtgaacaagctgaaagataatcaattggggtacgaatttattaagaaccaccatggacagaaagttgaggtcggcttcggtaagacagtggagatctttagtgtggacagctatgaaaggttcgtcaaagagcagtacgcgaagtccgggattaagatgaaaaagctcctgatggatgacatacctgaacagttcatcgagcgacaactaaatgattctcggtacatttcgaaagttgtgaagggcctgctcagcaacatcgtgcgcgagaaaaatgactccggagaatatgagccagaagccgtatcaaagaacattctggtctgcaccggcagtgtgactgatagacttaagaaagactgggggatgaatgacgtttggaactctatcgtgagccccaggtttgagcggttgaatgctctgaccgaaacacagtgtttcggacactgggagaacaaggatggtaaaaaggtctttcagaccgcagtgcctttagagtaccaaaaaggcttctccaagaagcgaatagaccatagacaccacgccatggatgctatcgttattgcctgcgcaactcgcaatcatgtgaactatctcaacaatgaatcagcgagcaggaacgccaaaatctctcgttacgacctgcagcggcttctgtgcgataagtccagaggggacggaaatggcaactataggtggattatcaaaaagccatggacaacgtttacccaggatgctcgcgaggccctaagtggtataattgtaagcctcaaacagaatctgcgaatcatcaacaagactacaaatatttaccaacacttcgacgcaaacgggaccagagtctatgaaaagcagaaaataggcgattcttgggctatccggaagcccatgcataaagacacagtgtttggagccgtgaatttgaggaaggcactgattccgcagcactacaacttaactctcttcatctcctcatga

SEQ ID NO: 2881 - RNA, 3642 nt, synthetic construct
  misc_feature 1..3642: note = Cas9 variant
  source 1..3642: mol_type = other RNA
atggagaagagactgggcatcgacgtggggaccaacagcctcggatgggccattgtcgaagttgatgacgagggttgcacacttctggataggggcgtggacatattccaggaaggggtagctcgggagaaaaatcaagaaaagcccgcagtgcaggatcgcactgacgcccgagcgttgcgtagacactactttaggcggcgcttaagaaaaatcgctctgctaagggtcctcgtgcggcatgatctgtgtcctgccctttccgaggagcagctgaacgcatggcagggaaagggcatttatccattggacgatgccttcatccgctggcaacgaacggacgataatgctgacagaaacccgtacagggatcggtttcgttgcctcaccgaagaactggacctggcatgtcgcgaagagagatatgttctcggtagggccttataccacctgtgccagcggcgagggttcctttctaatcgcaaagacgctggaaacgaggccgaagagggcaaggtgaagcaggaaattaaaacattgtcagcggatatggcagccgctggctgtgagtatctgggggaatacttttatagactataccagaggaaggagaaaatccggaagcattacactgcccgcaatgagcactatctcgcagagttcagagctatatgcaggaaacaacgtctggacgaggaacttcggcaggccctggagaaggcgatcttttaccagcgacccttgaagagtcagaaaggactcgtcggtaagtgtaccttcgaaaaagataagagcagatgccctgtgtcccatccaaggtttgaggagttccgcatgctgcaatttattaacaatgtacgggttacaggccccggggacgccgaacctagaccattatctcccgaggaagtggagatcgtcaggcctctgttcctccgcaaatcgaagccacactttgatttcgaagacattgctaaaaagatcgcaggaaagggcaactatgcctgtcgaggtgagcttctgcaggctccgtaccggttcaattgcgccgggaaatcaaccgtgactggaagccccgtgagtgcattgtttgcctccgtcttcggcgatgactggcagcgtgagatatgttctctatatacactgggcgctgggaagaacgaggagcaaattctcaatgatgtttggcacgtgctgtttgcgttcgaagacgaggagagacttcaggcatggctgcaggaaaaattgcagctcagcgccgatgacgctaagaccctggccgcatttaggttacctcaaggatacgcctccctgtcactaaacgtaatcaataaaattctcccatatctgcgccggggttacagatacgacgaggctgtgttctttgccaaccttggcaaggtcttgcccgcagaagtgtatgcggatcctgctaggcgacgcgaggttgaacaggggatcagtgcccagatggacgatctgggagacggcgagaagacgcggaaagaggaaagaatcagggattacctccgtcgctattggggtgtggaggaaaagcggctggagagactttaccatccaagcatgattgaagcatatccctctgcctccccgaacgggcagggcctgttgcaactcggatcacctaggatacccgctgtccgaaatccaatggccatgcgggcactgttccgcttaagagtgctgctaaacgagctcctgagggagggcaaaatcgaccgggggactaagattaatatcgaacttgctcgagagttgaacgatgccaataaaagaaaggcgatagaacgctaccagagggagcgtgaagccgagaaccggaagtatgctgaggaaattagacagcagtacgtagaggcaaccggacacagcatcgaacctagtgaggaggacatcctgaaatacaggctctgggttgaacaaggtcattgctctctgtatacaggcaagactattgggatctccgagtttttaggagatggccgccgatacgacattgaacacaccgtgcccagaagccggggtggggaggatgcccagtataataaaacactgtgcgaagaggagttcaacagggacataaagcgcgataaacttccatcggaattggctaatcacaccgccatcctcgcatgtgtcgagtcttgcggctggtttgaacgtattgagggactggaacatagagtgtggggcgcggaccggagggccaagtccgctacgactaagtcagccaaagacttcgcaatccaggatcgccactactggcgaatgcatctagactattggagacggaagtgtgaggcttttacaatgaccgaggtccccgaagggttcagtaacaggcagggagtggatgttggtatcattggccgctacgccagactgtatctccaaactgtgttcgacagggtatacacagtcaaaggggcaaccacggccgcttttcggcgtatgtggggactgcaggaggaatacgcggccaaggagcgcgtgaatcacgttcatcactgcatagatgcaatcaccattgcttgtatcggcagccgagaatatgccctttgggcccagtacgtgagacaagacgagttgtataggtggggtgaggctgataaacctcggtgcgggaagccatggccgacattcactgaagacgtccgcgcaaccgccgatgagctgttaatttcccaccatacacccgacaacatgcctaaacagtctagaaagaggctccgggtgcgaggcaaggtacagagaaatgatcgcggagaagtgaaatacatgcagggcgacactgcgcgaggggctctgcaccaacagaccttttatggagccatcgagcgggatggcgagatacgttacgttgtcagaaagagccttgaccagctgttgccagcagacgtggagaaaatcgtggatgaagccgtcaggcagaaggttcgcgaagctgtggaggcatatggtttcaaagaagccacagaccccaccaagcatactgtgtggatgaacgaggagaagcaaattcctatccggaaagtaaggattctcacgggggtcaagaatccaatcctgctaaaaccccacagagatgtgtcagttaaggaatacaaaaggtactatcacgtggtcaacgacggaaactactgtatggcgatatatgagggccgcgatcggcagggtagactgaagcgtacatttgaaattgtgaataagctcgaggctgccaggtacttcaaacggagtgcagaccgcgaatcccgaccggatctggttcctcttagcgacgtgaacggctattctttgaagtacctgttaaaaaccgggactatggtactcttttatgaaaattcaccagatgagctgtacgaatgcagtgtcggagagcttgccaagagactgtacaaagtggtgggcatggctcaggacgggagggtccagttcctatttcatcaagaagcccgggatcagaaggcagttaccgctgagtgtggaatgggcatcagcgtgttcgacgcccgccaccccgcgcctaagctcagaattagggtatccaactttaaaatgttcgtggaaggttatgactttgagctgacagtcaccggggaggtgaagttcaaacgatga

SEQ ID NO: 2882 - RNA, 3642 nt, synthetic construct
  misc_feature 1..3642: note = Cas9 variant
  source 1..3642: mol_type = other RNA
atggagaagagactgggcatcgacgtggggaccaacagcctcggatgggccattgtcgaagttgatgacgagggttgcacacttctggataggggcgtggacatattccaggaaggggtagctcgggagaaaaatcaagaaaagcccgcagtgcaggatcgcactgacgcccgagcgttgcgtagacactactttaggcggcgcttaagaaaaatcgctctgctaagggtcctcgtgcggcatgatctgtgtcctgccctttccgaggagcagctgaacgcatggcagggaaagggcatttatccattggacgatgccttcatccgctggcaacgaacggacgataatgctgacagaaacccgtacagggatcggtttcgttgcctcaccgaagaactggacctggcatgtcgcgaagagagatatgttctcggtagggccttataccacctgtgccagcggcgagggttcctttctaatcgcaaagacgctggaaacgaggccgaagagggcaaggtgaagcaggaaattaaaacattgtcagcggatatggcagccgctggctgtgagtatctgggggaatacttttatagactataccagaggaaggagaaaatccggaagcattacactgcccgcaatgagcactatctcgcagagttcagagctatatgcaggaaacaacgtctggacgaggaacttcggcaggccctggagaaggcgatcttttaccagcgacccttgaagagtcagaaaggactcgtcggtaagtgtaccttcgaaaaagataagagcagatgccctgtgtcccatccaaggtttgaggagttccgcatgctgcaatttattaacaatgtacgggttacaggccccggggacgccgaacctagaccattatctcccgaggaagtggagatcgtcaggcctctgttcctccgcaaatcgaaacttcactttgatttcgaagacattgcaaagaagatcgctggaaagggcaactatgcctgtcgaggtgagctgttgcaggctccataccggttcaattgcgccgggaaatcaaccgtgactggaagcccggtgagtgcactatttgcctccgtcttcggcgatgactggcagcgtgagatatgttctctgtatacactcggcgctgggaagaacgaggagcaaattctgaatgatgtttggcacgtgctttttgcgttcgaagacgaggagagactgcagacctggttgcaggaaaaactccagctgagcgcagatgacgccaagacgttagctgcctttaggctgccccaaggatacgcatccctatcactcaacgtaatcaataaaattctgccttatcttcgccggggttacagatacgacgaggccgtgttctttgctaacttgggcaaggtcctgccagccgaagtgtatgcagatcccgcgaggcgacgcgaggttgaacaggggatcagtgctcagatggacgatctcggagacggcgagcagactcggaaggaggaaagaatcagggattacctgcgtcgctattggggtgtggaggaaaaacggcttgagagactgtaccatcctagcatgattgaagcctatccatctgcatcccccaacgggcaaggcttgctccagctgggatcaccgaggatacctgccgtccgaaatcccatggctatgcgggccttattccgcctgagagtgctactcaacgagctgcttagggagggcaagatcgaccgggggaccaaaattaatatcgaattggcacgagagctgaacgatgctaataagagaaaagccatagaacgctaccagagggagcgtgaagcggagaaccggaagtatgccgaggaaattagacagcaatacgtagaggctacaggacacagcatcgaaccaagtgaggaggacatcctcaagtacaggctgtgggttgaacagggtcattgctctttatatactggcaaaaccattgggatctccgagtttctgggagatggccgccgatacgacattgaacacacagtgcctagaagccggggtggggaggatgcacagtataataagaccctttgcgaagaggagttcaacagggacataaaacgcgataagttgccctcggaactcgccaatcacacggctatcctggcctgtgtcgagtcttgcggctggtttgaacgtattgagggactagaacatagagtgtggggcgcagaccggagggcgaaatccgccactacaaagtcagctaaggacttcgccatccaggatcgccactactggcgaatgcatctggactattggagacggaaatgtgaggcatttaccatgactgaggtcccagaagggttcagtaacaggcaaggagtggatgttggtatcattggccgctacgctagactctatctgcagacagtgttcgacagggtatacaccgtcaagggggccacgaccgcagcctttcggcgtatgtggggacttcaggaggaatacgctgcgaaagagcgcgtgaatcacgttcatcactgcatagatgccatcacaattgcatgtatcggcagccgagaatatgctttgtgggcccaatacgtgagacaggacgagctgtataggcggggtgaggccgataagccccgctgcgggaaaccttggccaactttcaccgaagacgtcagagctacagcagatgagttactcatttcccaccatactccggacaacatgcccaagcagtctaggaaacggctgcgagtgagaggcaaggtacagcgcaatgataggggagaagtgaagtacatgcaaggcgacaccgccagaggggcgcttcaccagcagacattttatggagctatcgagcgtgatggcgagataagatacgttgtcaggaaaagcctggaccagttgctccctgccgacgtggaaaagatcgtggatgaggcagtccgccaaaaagttcgggaagccgtggaggcttatggtttcaaggaagcaaccgacccaactaaacatacggtgtggatgaacgaggagaagcagattcccatccgaaaggtacggattctgacaggggtcaaaaatcctatcctactgaagccacacagggatgtgtcagttaaagaatacaagcgctactatcacgtggtcaacgacggaaactactgtatggccatatatgagggccgggatagacagggtcgtctcaaaaggacctttgaaattgtgaataagctggaggcggctcggtacttcaagcgcagtgccgaccgagaatccagacccgatcttgttccgttgagcgacgtgaacggctattctctgaaatacttactcaagactgggaccatggtactgttttatgaaaattcacctgatgagctttacgaatgcagtgtcggagagctggcaaaaaggctatacaaggtggtgggcatggcccaggacgggcgggtccaattcctctttcatcaggaagctcgcgatcagaaagccgttacagcagagtgtggaatgggcatcagcgtgttcgacgctagacacccagcccccaagctgaggattcgagtatccaactttaagatgttcgtggaaggttatgactttgagttgaccgtcactggggaggtgaaattcaagcggtga

SEQ ID NO: 2883 - RNA, 3651 nt, synthetic construct
  misc_feature 1..3651: note = Cas9 variant
  source 1..3651: mol_type = other RNA
atgaccaagatcctgggcattgacacagggactaacagcctcggatgggccatagtggataaaacggctgacaattacaaccttctggataagggtgtcaatatcttccaggagggcgttaaaattgaaaaggggatcgagtcctctaaagcagccgaaagaaccgagcacagggcgacacgggtgcgctattaccgaattaagttgcgtaagatcagattactgaggatactatcagacaaccatctctgcccacctctgagtcaagaagaacttagcacttggcggctgaaaaaggtatatcccaaaaatgagttgtttatgcagtggcagcgcaccgatgacgatacagaaaagaccccgtacgcttatagacacaaatgtatccatgagaagctcgacctgtccgatgtgactgacaggtacattctgggacgggccttctatcacatcattcagcgccgaggctttctctctaacagaaaggaacaaggtggggaggattcgggaaaagtcaaggagggcatctcaacattaacccatgaaatgaatgaggcaggctacgaatacctgggggactatttctacgccctttataacaaaggagagaagataaggaaacactacacggctcggaatgaacactttttgagcgagttcaaggcaatttgcgagaaacaggatctggaaaaggagctaggtagtgaagtggttcgtaacatcgagaaggccatttttgaccagcgccccctcaaatcccagaagggccaagtggggaaatgtgtcttcgaaaagaataaaactaagtgcccttctagccatccaatgtatgaggagtttagaatgctgaccttcatcaacaatatcaagattaaaacacccaacgacgatgtgcttaggcctctgaatactggagaacgggagaagataatgccattgtttttccgaaaatccaagaaacagtttgacttcgaagatatcaccaagaagctcgctcccaaaaagatgtacggcttctataaaaaggaggaagacgccgagatgccttttctgttcaactacccaatggatacatcagtaagtggttgtccggttaccgcggcattaaaagacgtgtttggggatgactggattacggccatctgcgagacttacacactgggagaaggcaagagccgcttcgatatagtcaacgacatttggcacgctctctatttttactctgataaggacaaacttgccgagttcgcaatcaatagactgcagttgtccgaagacgaggctaagatcttttcagagattagcctacccgccgattatgcgagtctgtctctcaaagccatctgtaagattctgccttaccttaggcggggcctgatatattcccatgcagtgttcttggggaacctctgcgaagtgatgccaaaatacgagtggagcatcaaggaaatgcgcgagaccattatcgacaatatcattatggaaatggataaatgtgacactaaggataagagaacatttgaggtctgcataaaagactatctgaagggacagtacaacgtttcggataattctctgaaaaagctgtaccacccctccatgatcgagacctatcctagggtgcaatacacgaacgaacacggtgtatatcagctaggctcaccacgtattgacagtgtgcggaatcccatggctatgcgaagcatgttcagactcaggaaactggtcaaccgccttttggtggaggggaagatcgatcagaataccgaagttcatattgagtttgcccgggaactgaacgacgctaataagagaaacgccatcgcactcttcgtgaaagagaatcaatccgccaacgatgaggctaggaagcagataatcacactgtttaaaaaggaaactggaaccgacattgagccgacagataaagacatccttaagtacgtcctgtgggaggagcagaatcacatttgtttgtatactggcaagcagatccgcatatctgacttcattggtgcgaaccctaaattcgatatcgaacataccattccccgaagcgtagggggcgactcaacaaagatgaacctcaccctgtgcgatagtcggtttaatcgtgaggtgaaaaagactaaattaccagttgagctgcctaaccacgacgaaatcatggagagaataaaggaatggaagaaaaattacgagctactcgatatccaaattaggaagaacaaaaagctgtccaaaggagcaacgacaaaggagcagaaagacaccatcattcgcaagcggcatcttttggaactgagaagggattattggcgaggcaagtacgagcgcttcactatggaaagcgtgcccgaggggttttctcggagacagggaaccgacatctcagtcataagtaaatacgccaggctctatttaaagagcttattcaatcgtgtgtacacagtcaaaggtattgctacctccgattttcgcaagatctggggcatccaggacatttattctaaaaaggaacggatcaaccacgtgcaccattgcattgatgccatagttatcgcatgtattgggctggacgagtacaataaacttggagcctattaccacgatgaggaaaacaataaatggtatggcatgtcgaaggctagcttcaaaaagccatgggccacttttgtggaggacatcaaaaagattcaagacgaaatcttggtataccattacacacccgataacatgcctaagcagggtagaaggcgaataaaaatcgacgggaagaaaattctctgcaagggcgatgcagcgcggggatccctgcacaatgacacgtattacggcgctatcgagaacgatggggccgtcaaatatgtgaagcgcattgacctagcatcactggaagagaaggatgttaaaaatatcgtggacgataccgtcagaagtataattgaggccgctatcaaggaaaaaggattcaaggacgccatggcatctactatctggatgaacgaggaaaagagggtgccaattaagaaggtacggtgttttacaccgagcataaccaaacccctcaatatccgaaagcagagagatgtgtccattaaagagtacaagcagcaatatcacgttgctaacgactcaaactacctgcttgccttgtatatcggtacagacaataaaggcaaggaaaaacgcgagttcgagattgtcaacatcctgcaggcggcccagtactacaggactagcaatgataaggaagtggtggaccgtcatatagtccctatcaagtctgagcacgattatccatttgcttacaccttaaaaattgggacgatggttctcctgtatgaaaagtcccccaacgaggtgtgggacgcaaccatcaaagagcggaatagaaggctttacaaggtgacaggactgagtactatgcgcatgaaaggccgaaacggtgaatatgcctacgctaccgtaaagttgattcataatgaggaagccagacctagcaaggatatcaaagcaaagaacggggagtatgaacagggcgaggagttccggccagcgataattatgctccacacacaactgaatgccctagtccagggatacgactttgaaatcaacgagctgggcgaaatcaggcgcctccgttga

SEQ ID NO: 2884 - RNA, 3654 nt, synthetic construct
  misc_feature 1..3654: note = Cas9 variant
  source 1..3654: mol_type = other RNA
atggagaagcagagaatcctgggcctcgaccccgggaccaacagccttggatgggccgtgctggatttcgacaattccaaacaagaatacaacttggtcaggaagggtgaggttatttttgaagagggcgtggggaaatctgaacggggagagttctcaaaggctgcatatcgcacattttacaaaagtactcgaaagcactatttccgtagaaggttacggaagatagaggtactgaaagtgctagtcaagtacgatttttgcccttatctcagcgacgatctgcttaaacagtggcatgaaaagaaaatctacccagccgtgaaggagttcatggactggcagcgcacgtccgatgcggaaggcaagaatccgtattacgacagacactgttgcctgaacgagaaattggatctctctctgaagtcggacaggtacattctgggtcgggctctctatcatttaacccagcgccgagggtttaaatcaaatagactgatccaaaacaatgatgagaacgaagagggaaaggttaaaaagggcattagcgaacttagtacagagatgcaggaagccaattgtaactacttgggcgactatttctacaaactgtatactgagaaggggaataccgtgcagatcaggaagcggtacacagatcgtgagaaacactataagaacgaatttaatgcaatatgcgagaaacaggaactaaacgagaccatcgtcaaggaactcgacaaagccattttctttcaacgcaagctgaagccccagagacatggagtgggtaaatgtactttcgagcctaataacaggcggtgcgctatctcccacccagactttgagcgattccgcatgctttgtttcattaacaatatcaagataaaaacaccctttgaagagaacctgagacctttgaataacgaagagaaggcactcattgaaccactgttctacaggaaatctatcaagaattttgatttcgaggagattgccaagaaattagctggcaagaacaattactgctatatcaaagacgatagctccaagcagtacaaatttaactatcggatgtcacagggggccagtacctgtcaaacgatcgcgaagctcaagagcattttcggagaagagtggaaaaatggcatagcagaaacttacaccaaccgcagaaagaaagagggtctcaagaaacaggccgagatggtagacgatatctggaatgttctttattctgtgtccgaatgcgacgtcctgaaggattttgctattaacaaattgcagctagacgagaagacagccgataatttctcaaagactaaactggcacaagggtttgctaccctcagcctgaaggccatcaggaaaatacttcccttcctggaacagggatttggctacacagaggcggtgttcttggccaacattcctaccgtggtcggcaaggaatattggaataacgaggacatccgtaacgatatcatggaggaaattaaaacgatcttttaccacaatactctcaagacaaacgacagtcataataccattctgttctgtataaaggacatcttatctaacaatttcgatctggcaccaggggctattgacaaactataccacccgtccatgatcaacgtttataaggatgtgatccccaatgaggacggtattctccagctgggaagccctaaaatagatgccgtaaagaacccaatggctatgcggtcgcttcatatcattcgaaaagtggtcaatgaattgctgagagagggcatcattaactctgacactgaagtgaggatcgagtacgcccgcgagctcaatgatgcaaacaagcggcacgccatagctgactggcagaagaaacaatatgggaagcaccagaaatacagaaaggaaatcaaagagctgtttaaggcggaaacaggattcgagattgaacccaatgagaccgatatccttaagtttgagctgtgggaggaacagaaccatatttgcttgtatacgggccaggaaatcggtatatccgagttcgttggggagaatcctaaatacgacattgaacacacctttccaaggtcactcggcggagatagtacaaagatgaacatgactctgtgcgagaacaaattcaatcgcgaaaacaagcaaaagaaattacccagcgagctggcaaatcattccgaaatcctagagcgaattgacgattggaaaaagaagatctatatactccagaaaaagtacgactctatccggacccacaacggcatggacaaagagaataaggataaaaagattgtgagccgtcataagatcaaactggaacttgactactggaaggggaaatataacagatttacaatgactgagattccggaaggattctcaaggcgccagggtatgggcatcgggttgataagtcggtacgccggactgtatctcaagaccatttttcacaaaaaggataatcctcagaagtccaacgtctacatcgtgaaaggcagcatcacagctgagttcagaaggatttggaatatccaagacgattatgaaaagaaatgtcgagacaaccacattcatcactgcatagatgccatcgtagttggttgtattgggaagcgcgagtacgacctgatggcacagttttatcgggatgaggaaaaatacagatgggagaagaagaaaaagcccttctttaaaaagccatgggaaaccttcactcaggacatgttatctctgaaagatgaggtgcttacggtccatttcaatccttcaaactttacaaagaaggcccacaaaaaggtgttcacccccaaaggcatctttgtcgctcagggagactgcgccagggtgaagttgcacaaaggcagttacttcggggcaattgaacaaaagggagagatcaaatatgttatgcgtaaggagctcagcgcgctgaagatagaagatatcaaaaatattgtggacgctgtagtcaaggagaaagtgctagccgttgtgaagaaaaagggttttaagcaggcaatggccgaaccaatctacatgaacgaggacaaacgcattctgatcaagaaagtccggctgttcgtgtcccaggctaatcccctgatagtaaagaaacatagagatctttcttcgaaggagtataagcaaaactactatgtggacaacgaaggcaatttgatgattgccatgtacgagggggttaaaaagaacggaaaaatcgatagggaaatcactgtcgtgaataacctggaggcagctaagtttttccgacagagccagaaaaataacgccgaaaagcagttaatttcccacctctcacctaagaatggctatccactgaaaaccgtgcttacacaaaagcagctggtcttgatgtacgaggacagtccgaaagagataaagctccgggataccaaaaacatggttaagcgcctgtaccaggtgtttggtatcgaaaaagacgggagagtgaagctaaagttccatcaggaggcgaggtctgaaggcctgaatattaacagcgccgcttttaaaatccaagatactcccgagtccctctatcggcacacaaagtcaaatctgaaagtacttgtcaacggagtggacttcaagattaatatcttgggcgaaataagcctgatctga

SEQ ID NO: 2885 - RNA, 3654 nt, synthetic construct
  misc_feature 1..3654: note = Cas9 variant
  source 1..3654: mol_type = other RNA
atggagaagcagagaatcctgggcctcgaccccgggaccaacagccttggatgggccgtgctggatttcgacaattccaaacaagaatacaacttggtcaggaagggtgaggttatttttgaagagggcgtggggaaatctgaacggggagagttctcaaaggctgcatatcgcacattttacaaaagtactcgaaagcactatttccgtagaaggttacggaagatagaggtactgaaagtgctagtcaagtacgatttttgcccttatctcagcgacgatctgcttaaacagtggcatgaaaagaaaatctacccagccgtgaaggagttcatggactggcagcgcacgtccgatgcggaaggcaagaatccgtattacgacagacactgttgcctgaacgagaaattggatctctctctgaagtcggacaggtacgttctgggtcgggctctctatcatttaacccagcgccgagggtttaaatcaaatagactgattcaaaacaatgatgagaacgaagagggaaaggtgaaaaagggcatcagcgaacttagtacagagatgcaggaagccaattgtaactacttgggcgactatttctacaaactgtatactgagaaggggaataccgtccagattaggaagcggtacacagatcgtgagaaacactataagaacgaatttaatgcaatctgcgagaaacaggaactaaacgagaccatagtgaaggaactcgacaaagccatcttctttcaacgcaagctgaagccccagagacatggagtaggtaaatgtactttcgagcctaataacaggcggtgcgctatttcccacccagactttgagcgattccgcatgctttgtttcatcaacaatattaagatcaaaacaccctttgaagagaacctgagacctttgaataacgaagagaaggcactcatagaaccactgttctacaggaaatctattaagaattttgatttcgaggagatcgccaagaaattagctggcaagaacaattactgctatattaaagacgatagctccaagcagtacaaatttaactatcggatgtcacagggggccagtacctgtcaaacgatcgcgaagctgaaaagcatcttcggagaagagtggaaaaatggcattgcagaaacttacaccaaccgcagaaagaaagagggtctcaagaatcaggccgagatggttgacgatatatggaacgtgctttattctgtctccgaatgcgacgtgctgaaagattttgctatcaataagttgcagctagacgagaaaacagccgataacttctcaaagactaagctggcacaagggtttgctaccctcagcctgaaagccattaggaagatccttcccttcctggaacagggatttggctacacagaggcggtgttcttggccaatatacctaccgtcgttggcaaagaatattggaacaacgaggacattcgtaatgatatcatggaggaaatcaagacgatcttttaccacaacactctcaaaacaaatgacagtcataacaccattctgttctgtattaaggacatattatctaataacttcgatctggcaccaggggctatcgacaagctataccacccgtccatgattaatgtgtataaagatgtaatccccaacgaggacggaatcctccagctgggtagccctaagattgatgccgtgaaaaatccaatggctatgcggtcgcttcatataatccgaaaggtcgtgaacgaattgctgagagagggcattatcaattctgacactgaagttaggattgagtacgcccgcgagctcaacgatgcaaataaacggcacgccatcgctgactggcagaagaagcaatatgggaaacaccagaagtacagaaaagaaataaaggagctgtttaaagcggaaacaggattcgagatcgaacccaacgagaccgatattcttaagtttgagctgtgggaagaacagaatcatatctgcttgtatacgggccaggaaattggtatctccgagttcgtgggggagaaccctaagtacgacatagaacacaccattccaaggtcactcggcggagatagtacaaaaatgaacatgactctgtgcgagaataagtttaaccgcgaaaataaacaaaagaaattacccagcgagctggcaaaccattccgaaatcctagagcgaattgacgattggaagaaaaagatctatatactccagaagaaatacgactctatccggacccacaatggcatggacaaggagaacaaagataagaaaattgtcagccgtcataagatcaagctggaacttgactactggaaagggaagtataatagattcacaatgactgagattccggaaggattttcaaggcgccagggtatgggcatcgggttgataagtcggtacgccggactgtatctcaaaaccattttccacaagaaagataaccctcagaagtccaatgtgtacatcgtaaagggcagcatcacagctgagtttagaaggatttggaacatccaagacgattatgagaaaaagtgtcgagacaatcacattcatcactgcatagatgccatcgttgtgggttgtattgggaaacgcgagtacgacctgatggcacagttctatcgggatgaggaaaagtacagatgggagaaaaagaagaaaccctttttcaagaaaccatgggaaacctttactcaggacatgttatctctgaaggatgaggtccttacggtgcatttcaacccttcaaatttcacaaagaaggcccacaagaaagtctttacccccaagggcatcttcgtggctcagggagactgcgccagggttaaattgcacaagggcagttactttggggcaattgaacaaaaaggagagatcaagtatgtgatgcgtaaaaagctcagcgcgctgaagatagaggatatcgaacatattgtagacgctgtcgtgaaagagaaggttctagccgtggtcaaaaagaaaggtttcaagcaggcaatggccgaaccaatctacatgaacgaggacaagcgcattctgatcaaaaaggtgcggctctttgtatcccagactaatcccctgatagtgaaaaagcacagagatctttcttcgaaagagtataagcaaaactactatgttgacaacgaaggcaatttgatgattgctatgtacgagggggtcaagaaaaacggaaagatcgatagggaaatcaccgtggtgaataacctggaggccgcaaaattctttcgacagagccagaagaataacgctgaaaaacagttaatttcccatctctcacctaagaatggctatccactgaagacagtccttacccaaaaacagctggttttgatgtacgaggacagtccgaaggagataaaactccgggatactaagaacatggtgaaacgcctgtaccaggtgttcggtatcgaaaaggacgggagagtagagctaaaatttcaccaggaagccaggtctgagggcctgaataagaacagcgcggccttcaagattcaagatacacccgaatccctctatcggcatacgaaatcaaatctgaaggtccttgtgaacggagttgactttaaaatcaatattttgggcgagatcagcctgatatga

SEQ ID NO: 2886 - RNA, 3654 nt, synthetic construct
  misc_feature 1..3654: note = Cas9 variant
  source 1..3654: mol_type = other RNA
atgaagtacaactatgtgctgggcctcgacatcgggattagctccgtcggatggggtcttctggccttggatgagaataacaatccctacaaaataatcgacgttggctctagaattttctcacctggggaagtggagaagaccggagatagtaaagctaaggaaaggcgggagaaacgcggcacacgacgtgtaatcagaaggcgggaatttcgcttagacagagtgaggaacctgctatatgagaagggttacctcaaggggaatattactagcaacatcgtctccgtgaaaaatgaggaactgacgataatcttcaacgatatggttaataactattacaagtctaaagacaccaatccatataagctgaaagtggaggcactggatcggaagttgacaaacgacgaactctcgattatcctggtccactacgccaagaaacgcggatacaagtcaaatcgagaggagagcagtgataacgacaatggcaaagtgaaggaagcgattaaagagaacactaacctgatggaagagaagaaatatagaaccatctccgaaatgtacataaagaatgagaagtttaaaaacaagattaaaaatggcccggatgactataagctctctgtaacaaacgagatgtacttagaagagatcaataaagttctggatagccagattgggttcggacttatcgacgacaactttaagaatgaatatttggagatctacaactccaggcggcattattcagaaggtcccggctactactatgctaaggatgccaatgggaacaaagtgaaggtccgtagtccttacggaggcgacctgattaaaaagatgaccggtgtgtgcagcttcgataaaaaggcacgcgccccaaagtatgctttttcttccgagctattcgtgtcaataagcaaactcgtcaatctgagatacaagatcgacgatgacagttataaacaacttactaaggagcagattaacgaactgatcgatgaggctaaaaataagaacaaggttacatacaaatctttgataaagattctcgggatcaaaaatatcaaggtgaaagacctgaacttatccaagagcgaatatattaaagtaatcgatgagctgaagaagaaactcaacatttcgaaggaagagaaaatagacatctactctcttgatgaggaaaataagaaaatttacgacgacatctataacgagaagctgttttccaagaccttgatcgagttcaaaggatacaatctactgaagaaagccattacgctctcatataacagtggcacttggaatgatgtgaaggacaacatagaatttctggatgagcttgctctgtactgtaccgactataaagtcaataacgaaatccaggagcacattcataatagcttgatcattgattccaggttcgacgattctaactttgtggaaaatctccccaacttcaaggaccacctgatgttaagcacagatatcatacggaagctgatccctattatgctagagggcatcacttacgacaaagccatggataagattgggtataatcattcaaacctctacaaagacaccatcaaggaagatctgcttgttccagtgtacgtcagtaaaaatataacaaaccagcgagtgattcgctccttgacccaagcgagaaaggtaatcaacgcaattatcaagaaatatggaagccccaagataatcaatattgagacggccagggagctggctaaaactcagaaggaacggcgcatcattgagaaaaaccagcaggacaagcaatacgaaaatgagagaatcaaaaagcacctcgttgaactggagcttttctctgacgagtcaaagataacaggtaacgatctgttgaaatataagctctggcaggaacagaaagagttttgcggctacagtatgaagaaaattaagctggaagacttattcagcaataacatcgtgcagatcgatcacattctgccttattccaggacctacaatgacaactatctaaataagactctcgtctacacaaaatacaaccaagataaggggaataaaaccccatatgagtggtttggaaagacggacaaatggcaggaatacgaggccttcatcaactctctgtcgattagccagaataagaaggataactatcttttgaaaaatctggaccaagatgcagagcgtgaaatgcgggagcagaacctcaacgacaccaagtacatatcccgagaactgttatcactgatcaaagcatatcttaatgtggatgaggtcaacgcctttccgggcgcgattacagccaagttgagagcaaggtggggtttcaatcgcctcactcatagttacatctctaaaacctatattatgcccgaggacatgaagaaggggatcaacaaagatcgggacaatcaccttcatcacgctatggacgccctagtgatagctagcatcacaaagtccctgcagcagaaaattactctctacgaaaagttttcaagatacgttgatggcatcaccaaaaacgagctgggaaagattagcacaggcaatatcaacgacgatctttataattactatgacgaagagaccggggaaataaaggagttggagctgaggcaatacattaaaaaccaggtggcccagaataacatctatttctctaagcacaatgtatccaaattaatctttcctactccatacaacaatttcgtcgaagaggcaaagctccgcgtgtatgaacgagatctggaggttcttaaatggaacctgaagaatttgggaacgtacacaagtagcgaactcaaccggattcatgtgctgataccctctgtcgccaaaaacaagatctccggtcgtctacacgaggagacctactatggcctgaaggaagtggggattggagaggacaaagtaacttacaagaccctcaaaacacctatctcaaaggtgaaaaagaaggatctggacaatattccagattgtaaaggcggtagtaaggacatctataacgctcttgttaaatggtttgggaattgcgaaaccggcgaggaagcgttgaagatgcatgatggaaaataccccgtcaacccgaatgacaaggagcagaaggagataagaaaaatcaaggtgtatactaaatacaacgcaacaggccacgtggtcaataacgggaatgttgaaaagggaggtatttataggatcgacgtgttcaaaagcaagaacaaggaggataataaactgtactttacgtcgtacgacattttcgaaatcgagcaaataaaggcctatgagaaaggcaagaacattaatttctccatcaaattagaatacgggcagggaaagaacaataaaatcctcctgtataaggatgtgaagaacgagtacgaccttattatgtctatctataaaaacgatctgatacgcattaagaccaaaactggcaataagagcacagcttacgtagtcggtttttcagggggcaaactagaaatcaagagtaccattggagacggctatgatatcatagggaacaataacattttcgacaagtccatggagcggtacagagtgacatctagcactatcgttaaaatcgataagctctccatttcaatcctgggagaagtgagcggcttgtga

SEQ ID NO: 2887 - RNA, 3657 nt, synthetic construct
  misc_feature 1..3657: note = Cas9 variant
  source 1..3657: mol_type = other RNA
atgaacaagagaatcctgggcctcgacaccgggacaaatagccttggatgggccgtggtcgattgggacgagcacgctcagtcctacgaactgattaaatatggtgatgttatattccaagagggcgtgaagatcgaaaaagggattgagtcttcaaaggcagccgaaaggagtggatacaaagcgatccggaagcagtattttcgccgacgtttgagaaagattcaggtattaaaagtgctggtcaagtaccatctatgcccctatctcagcgacgatgacctgaggcagtggcaccttcaaaaacagtaccctaagtccgatgagctgatgttgtggcagcggacttctgacgaggaaggcaaaaacccatattacgatcgccatagatgtctccacgagaagctggacctgacggtggaagctgataggtacaccctcggtcgggccttatatcatctgacacagcgccgagggttcctttcgaatagattggacacttcagcagataacaaggaggacggagttgtgaaaagcggcatcagtcaactgtccaccgagatggaagaggccggctgcgaatacctaggggactatttttacaagctctatcacgagcagggaaataaagtcaggatacggcagcgttacacagatcgcaagaaacactatcagcatgagttcgacgctatctgtgaaaagcaagagctgtctagcgaacttattgaggatctgcagagagcaatctttttccagttgccgctcaaatcccaaaggcacggtgtgggccggtgcacctttgaacgagggaagccccgctgtgccgactcacatcctgattacgaggagttcagaatgctgtgctttgtaaacaatattcaggttaagggaccacacgacttagaactgaggcccctcacttacgaggaacgggagaaaatcgaacaccttttctttcgcaagagtaaacctaacttcgattttgaggacatagctaaggaactggccggcaaaaagaattatgcgtggattcatgataaggaggagagagcatacaaattcaactataggatgacacagggtgtgccagggtgtcccaccacggcccagctaaagagcatcttcggagacgattggaaaactggcattgctgaaacctacacattgatccaaaagaaaaatggctctaagtccctgcaggagatggtcgacgacgtgtggaacgtgctctattcatttagcagtgtcgaaaagctgaaagagttcgcccaccataaacttcagctggatgaggaaaatgcagagaaatttgctaagatcaaattgtctcactccttcgccgcgctcagcctgaaggccattcgtaagtttttacctttcctgcggaaagggatgtactatactcatgcatcgtttttcgctaacataccaaccatcgttggaaaggaaatttggaataacgagcagtctcgaaaatacatcatggaaaacgtgggtgagctagtatttaattaccaaccgaagcacagagacgtgcagggcacaatagagatgctcattaaagatttcctggccaacaattttgaacttcccgctggggccaccgacaagttgtatcacccttccatgatcgagacgtacccacatgcactgaggaacgagttcggaatcctccagctgggctcaccccgcactaatgccattcggaaccctatggctatgagaagtcttcacgtcctgaggcgcgtggttaatcagttgctcaaagaaagcatcattgatgaaaacacagaggtgcatgtcgagtatgcgcgagaactgaatgacgcaaacaagcggcgtgccatagctgatagacaaaaggagcaggacaaacagcacaagaaatacggtgatgaaatcaggaagttatataaagaggaaaccgggaaggacattgagccaactcagacagatgtgctgaagtttcaactatgggaggaacagaatcactactgcctctataccggcgagcagatcggaatcacggacttcattggctccaaccccaaattcgatatagaacataccatcccgcaatctgtagggggagacagcacacagatgaatctgactctttgtgacaaccgctttaatcgggaggttaagaaagccaagttgcctaccgagctggcaaaccacgaagagattctcacaagaatcgaaccctggaaaaacaagtacgagcagctggtgaaggaaagggataaacagcgaactttcgccggtatggacaaggctgtcaaagatattcgcatccaaaagcggcataaattacagatggagatagactactggagaggcaagtatgagaggtttaccatgacagaagtgccagaggggttctcacgtcgccagggaaccggcatcggtctgattagtcggtacgccgggctttatttgaagtccctctttcaccaggcagatagcagaaataaatctaacgtctacgtggttaagggcgtggcgactgctgagttcaggaaaatgtggggactgcaatcagaatatgaaaagaaatgccgagacaatcatagtcaccactgtatggatgccatcacgattgcatgcatcggcaagcgggagtacgacctaatggccgagtattaccatatggaagagacatttcgccaggggagaggaagcaaacctaagttctccaagccctgggctacctttactgaagatgtactgaacatatacaaaaatctcctggtcgtgcacgacaccccaaacaatatgcccaagcatacaaagaagtatgttcagacctctaaaggtaaggtgcttgcccagggcgatactgcaagggggtcgttgcacctggacacatactatggagctattgagcgggatggcgaaatccgatacgtcgtgagacgccctttaagctccttcacgaacccaaaggagctcgagaatattgtagacgaaaccgtgaaaaggactatcaaggaggccatagcggacaaaaactttaagcaagccatcgctgaaccgatttatatgaatgaggataaaggtatcctgattaagaaggttcgttgcttcgcaaactcagtcaaacagcccatcaatatacggcagcatagagaccttagtaagaaagagtacaagcaacagtatcacgtgatgaacgaaaataactacctgttggccatttacgaggggctcgtgaaaaacaaggtcgttagggaatttgagatcgtgtcttatatcgaagctgccaagtactataaacgcagccaggatcgaaatattttctcctcaatcgtgcctacacacagcaccaagtacggcctgccactaaaaacaaagctgctcatgggacagcaagtactgatgttcgaggagaaccccgacgaaattcaggtcgataatactaaagaccttgtgaagagattgtataaggttgtgggcatagagaaagatgggcggatcaagtttaaacatcaccaggaagcaaggaaggagggactgaccatttactctacgccttataaaaacaatgacgattacgtcccaatcttccgccagtccattaagaacatcaatatattagtggacggcatcgattttaacattgacatcctcggtaaagttaccctgaaggaatga

SEQ ID NO: 2888 - RNA, 3657 nt, synthetic construct
  misc_feature 1..3657: note = Cas9 variant
  source 1..3657: mol_type = other RNA
atgaacaagagaatcctgggcctcgacaccgggacaaatagccttggatgggccgtggtcgattgggacgagcacgctcagtcctacgaactgattaaatatggtgatgttatattccaagagggcgtgaagatcgaaaaagggattgagtcttcaaaggcagccgaaaggagtggatacaaagcgatccggaagcagtattttcgccgacgtttgagaaagattcaggtattaaaagtgctggtcaagtaccatctatgcccctatctcagcgacgatgacctgaggcagtggcaccttcaaaaacagtaccctaagtccgatgagctgatgttgtggcagcggacttctgacgaggaaggcaaaaacccatattacgatcgccatagatgtctccacgagaagctggacctgacggtggaagctgataggtacaccctcggtcgggccttatatcatctgacacagcgccgagggttcctttcgaatagattggacacttcagcagataacaaggaggacggagttgtgaaaagcggcatcagtcaactgtccaccgagatggaagaggccggctgcgaatacctaggggactatttttacaagctctatgatgctcagggaaataaagtcaggatacggcagcgttacacagaccgcaacaagcactatcagcacgagttcgatgcaatctgtgaaaaacaagagctgtctagcgagcttattgaagacctgcagagagccatctttttccagttgccgctcaagtcccaaaggcatggtgtgggccggtgcacctttgagcgagggaaaccccgctgtgctgattcacaccctgactacgaagagttcagaatgctgtgctttgtaaataacattcaggttaagggaccacatgatttagaactgaggcccctcacttacgaggagcgggaaaagatcgagcctcttttctttcgcaaaagtaagccaaatttcgactttgaagatatagccaaagcgctggcaggcaagaaaaactatgcctggattcacgacaaggaggaaagagcttacaagttcaattataggatgacacagggtgtgcccgggtgtcctaccatcgcccagttgaaaagcattttcggagatgactggaagacgggcatcgcagagacttacaccctaatccaaaagaagaacggctctaaatccctgcaggagatggtcgacgatgtgtggaatgtgctctattcatttagcagtgtcgaaaagctgaaggagttcgctcaccataaacttcagctggacgaagagtctgccgagaagtttgcgaaaattaagttgtcccacagcttcgccgcactctcgctgaaagctatacgtaagtttttaccattcctgcggaaggggatgtactatacacatgcctcctttttcgctaacatcccgactattgttggaaaagaaatctggaataaggagcagaaccgaaaatacataatggaaaacgtgggtgagctagtatttaattaccaacccaagcacagagaagtgcagggcaccattgagatgctcatcaaagatttcctggccaacaattttgagcttcctgcaggggccacagacaagttgtatcatccatctatgatcgaaacctaccccaacgctcagaggaatgagttcgggattctgcagctcggctcacctcgcacgaacgcgatccggaatccaatggcaatgagaagtctgcacattcttaggcgcgtcgtgaaccaactgttgaaagaaagcataatcgatgagaatactgaagttcacgtggagtatgcccgagagctcaacgacgctaataagcggcgtgccattgcagatagacagaaggaacaggacaaacagcataagaaatacggtgatgagatcaggaagctgtataaagaagagacagggaaggacatcgaacccacccaaactgatgtcttaaagtttcagctgtgggaggagcagaaccaccattgcctatacacaggcgaacaaattggaataaccgacttcatcggctccaatccgaaattcgatattgagcacacgatccctcagtctgtgggaggagacagcacccagatgaacctcacactgtgtgacaatcgctttaaccgggaagtaaagaaagccaaacttcccactgagttggctaaccacgaggaaattctgaccagaatcgagccatggaaaaataagtatgaacagctcgttaaggagagggataaacaacgaacattcgccggtatggacaaggcagtgaaagatatacgcatccagaagcggcataaactgcagatggaaattgactactggagaggcaagtacgagaggtttactatgaccgaggtccctgaagggttctcacgtcgccagggaacaggcatcggtttaattagtcggtatgcggggctgtaccttaagtccttgtttcaccaagctgatagcagaaacaaatctaatgtgtatgtcgtgaagggcgttgccaccgcagagttcaggaaaatgtggggactccagtcagaatacgagaagaaatgccgagacaaccatagtcaccattgtatggatgccatcactatagcttgcattggcaagcgggaatatgacctgatggccgagtactatcgcatggaggaaacgtttaaacaggggagaggaagcaagcccaagttctccaaaccatgggcaacatttaccgaggatgtgctaaatatctacaagaacctgctcgtagtccacgacactcccaataacatgcctaaacacaccaagaaatacgtgcagacatctattggtaaggttctggctcaaggcgataccgccagggggtcgcttcatttggacacttattacggagcgatcgaacgggatggcgagatacgatatgtggtcagacgcccactgagctccttcacaaagccggaagagttagagaatatcgtggacgaaacggtaaaaaggaccattaaggaggccatcgctgacaaaaactttaagcaggcaattgccgaacccatctacatgaatgaggagaaaggtatactcattaagaaggtgcgttgcttcgctaaatcagttaagcagcctatcaacatccggcaacacagagatctgagtaaaaaggaatataaacagcagtaccatgtcatgaatgagaacaattatcttctggccatttacgaagggttggtgaagaacaaggtggtcagggagtttgaaatcgtttcttacattgaggcagcgaaatattacaagcgcagccaggaccgaaacatattctcctcaatcgtgccaactcacagcacaaaatatggcctccccctgaagaccaaactactgatgggacaactcgtgctgatgttcgaggaaaatcctgatgagattcaggtagacaacacaaaggatcttgtcaagagattgtacaaagtggttggcatcgaaaaggacgggcggattaaatttaagtatcatcaggaggccaggaaagaaggactgccaatcttctctactccctacaagaataacgatgactatgctccgatatttcgccagtccatcaataacattaatatcttagtggatggcattgacttcaccatcgatatactcggtaaagtcacgctgaaggagtga

SEQ ID NO: 2889 - RNA, 3657 nt, synthetic construct
  misc_feature 1..3657: note = Cas9 variant
  source 1..3657: mol_type = other RNA
atgaacaagagaatcctgggcctcgacaccgggacaaatagccttggatgggccgtggtcgattgggacgagcacgctcagtcctacgagttcattaaatatggtgatgttatatttcaagagggcgtgaagatcgaaaaagggattgagtcttcaaaggcagccgaaaggagtggatacaaagcgatccggaagcagtatttccgccgacgtctgagaaagattcaggtattgaaagtgttagtcaagtaccatctgtgcccctatctaagcgacgatgacctcaggcagtggcatctgcaaaaacagtaccctaagtccgatgagcttatgctgtggcagcggacttctgacaaaaagggcaagaacccatattacgatcgccacagatgtttgcacgagaaactcgacctgacggtggaagctgataggtacaccctgggtcgggccctctatcatttaacacagcgccgagggtttctgtcgaatagacttgacacttcagcagataacaaggaggacggagttgtgaaaagcggcatcagtcaattgtccaccgaaatggaggaggccggctgcgaatacctgggggactatttctacaagctatatgatgagcagggaaataaagtcaggatacggcagcgttacacagaccgcaacaagcactatcagcacgaatttgatgctatctgtgagaaacaagaactctctagcgagctgattgaggaccttcagagagcaatcttctttcagctgccgttgaagtcccaaaggcatggtgtgggccggtgcaccttcgaacgagggaagccccgctgtgccgattcacaccctgactacgaggaatttagaatgctctgcttcgtaaataacattcaggttaaaggaccacatgatctggagttaaggcccctgacttacgaagaacgggagaagatcgaacctctctttttccgcaaaagtaagccaaattttgacttcgaggatatagctaaagcccttgcgggcaagaagaactatgcatggattcacgacaaagaagagagagcctacaagttcaattataggatgacacagggtgtgcccgggtgtcctaccacggctcagctgaaaagcatctttggagatgactggaagactggcattgccgaaacctacacattgatccaaaagaagaacggctctaagtccctacaggagatggaggacgatgtctggaatgtgctgtattcattcagcagtgtggaaaaactcaaggagtttgcacaccataaactgcagcttgacgaagagtctgctgagaagttcgccaaaatcaagctgtcccacagctttgcggccttgtcgctcaaggcaattcgtaaattcctgccatttttacggaaggggatgtactatactcatgcttctttctttgccaacataccgaccatcgtcggaaaagaaatttggaataacgagcagaaccgaaagtacatcatggaaaatgttggtgagctggtgttcaactaccaacccaaacacagagaagtacagggcacaatagagatgctaattaaggattttctcgctaataacttcgagctgcctgccggggcaaccgacaaactttatcatccatccatgatcgaaacgtacccccacgcccagaggaatgagtttggaatcttgcagctgggctcacctcgcactaacgctattcggaatccaatggcgatgagaagtctccacatcctgaggcgcgtggtcaaccaacttctgaaggaaagcattatagatgagaatacagaagtgcatgttgagtatgcacgagagttgaacgacgccaataagcggcgtgctatcgccggttggcagaaagaacaggataagcagcacaaaaagtacgtggacgagattagaaaactctataaggaagagaccgggaaggatatcgaacccactcaaacagacgtcctgaaattccagttatgggaggagcaggatcatcactgcctgtacaccggcgaacaaatcggaattacggacttcataggctccaacccgaagtttgatatcgagcacaccattcctcagtctgtagggggagacagcacacagatgaatctaactctctgtgacaacaggttcaatcgcgaaatcaaaaaggcaaaactgcccgcccagctttcaaaccatgaggagattttggctcggatcgaaccatggaagaacaagtatgagcagaaaataaaggaaagagataaacaaaggacctttgccggtatggacaaggcagtgaaagatctgcgaatccagaagcgccacaagctccagatggacattgattactggcggggcaaatacgagagattcacaatgactgaagttcctgaggggtttagtaggcgtcaaggaaccggcatcggtctgatttcccgctatgcggggttatacctgaaaagccttttccatcaggctgactctcggaataaatcaaacgtgtatgtcgtgaagggcgtcgccacagcagagtttagaaaaatgtggggattgcagagtgaatacgagaagaaatgcagggataatcacagccatcactgtatggacgccatcaccatagcttgcattggcaagcgagaatatgatctcatggccgagtactatcggatggaagagactttccgccaggggagaggatccaagcccaaattttctaagccatgggcaacgttcacagaggacgtgctgaacatctacaaaaatctactggttgtgcacgatacccccaacaatatgcctaagcatactaaaaagtacgtacaaacctcgaagggtaaagtcctcgctcagggcgacacagccagggggagcctgcaccttgatacctattacggagcgattgaacgggacggcgagatccgatatgtggttagacgcccattgtcctcatttactaagccgaaagaactggagaacatagtggacgaaacagtcaagaggacgatcaaagaggccattgctgataagaatttcaagcaggcaatcgccgagcccatttacatgaacgaagacaaaggtatcttaataaagaaagtgcgttgctttgctaagagtgtaaaacaacctattaatatccggcagcatagagatctctctaagaaggagtataaacagcagtaccacgtggttaacgaaaataactatatgctggtcatctacgaggggcttgtgaagaataaagtggtcagggagttcgaaattgttagctacatcgaggccgcaaagtattacaaacgctcccaagaccgaaacattttctcaagcatagtgccaacccattctgcgaagtatggcctgcccttgaagactaaactcctgatgggacagctagtgctgatgtttgaagagaaccctgatgaaatccaggtagacaatacaaaggatctcgtcaaaagactgtacaaggtggttggcattaaaaaggacgggcgggtgaaattcaagtttcaccaggaggccaggaaggatggacttttgatcttctccaccccatataaaaacaataacggctacgtccccatttttcgccacagtaagaaaaatatcaacatactggtggacggtaaggatttcacaatcgacattttagggaaagttactctcaaggagtga

SEQ ID NO: 2890 - RNA, 3660 nt, synthetic construct
  misc_feature 1..3660: note = Cas9 variant
  source 1..3660: mol_type = other RNA
atgaaggaggaagtgagaggcaaaaacaggagccagacctgggccatcctggctaagttctttgtctggtccgagaaagaatctgtttggaatgagaaggaagcacggacagaggagcgcgtgaaagaatacaagctcgtagggcttaagcgagacactaaaggaaacgagctgaagttggaaaattatcgttggagagtgcaagccttatcagagcagctgaaccccgagattgtcgcgatagtgctacaggaaatcaatggtcagattagtgctagctccggctacctcggggccatctctgataggtcgaaacaactgtatttcaaccggcagacggttggacagtaccttatgtcagagctggaaaaggaccctaatgtgagcttgcgcaacagagtcttttataggcaggattacctcgacgagttcgatcggatttgggaaaaacaagcagagtttcacgaggaactgaccgtggagctgaagaaggaaatccgcgacataatcattttctatcagcgaagactcaaaagtcagaagggcttaatctccttttgcgagttcgaaaagagggaggtagttgtggaggaagatggtcggaagaaaaataagacagtcgggtgtcgtgtgattccacgctctcatccgctgtttcaggagttcaaaatctggcaaactcttaacgacatagaagtgtttgcctgggataagcagagcaagcgcaaaaaggctgacaaatcctcaattttgttcgataatagtgaggacgcactgctagtcgaaggaaagaggtttctctaccaggaggagaaagaactgcttgccaaggagctgttcgttaaggaaagcatgaaaaaggctgaggtgttgaaactcctgttcgagaactaccaagaattagatctgaattttaagcagatcgacggcaaccacaccggcttcgccctcttttctgcgtattccaaaatgattgagaagtacgggtatgaacccgtagacttcaagcggtcagcagatgagatcatcgaaaaacttgagacaatttttaccaatctgggatggaacactgagttgctaagcatagacctgagtaaggaagataaagagctcgaacgacagtcttacttccgcctgtggcatcttctgtattcctttgagggtgacaacacacctaccggcaatgggaagttgctcgagaaaatcatgcagctgtgcgatgtggaaaaggagtacgccgtcgaattagctaacgtgagcttccaagaggactatggatcgctgtctgccaaggcaattaaaaagatcctaccatacctcaaagaaggcaatcagtacgatgttgcttgtgactatgccggttacagacactccaggtcaagtctgacgaaggatgagatagaaaacaaaattcttaaggacaaattggagatcctgcccaagaatagcctccggaaccctgtggtcgagaagatcctgaatcagatggtgaaccttattaatactctgatcgatacctatgggaaaccagacgaaattcgcgtagagttggcgagagaactcaagaaaaacgccaaggagagggaggaactgacaaaatccatagcacgtaatactcgggagcatgacgaaatccgacagttactgagaaccgagtttggaatgatgaacgtttctaggaatgatattatccgctacaagctatatgaggaactcaaggacaacggctacaaaacactgtatagcaatgagtacatcccccgggaaaagattttctcaaaagagatagatatcgaacacgtgattcctcaagctagactttttgacgatagtttgtccaacaagaccctggagtacagggccatcaacattgaaaaaggcaataagacggcttatgacttcgtcaaggagaaatacgggaacgatggactcgagaagtttctgaatcgctgcgaaactttattcaaagacaagcgaacaaaactgcggaaacttaagatggaggaaaaagatatcccagagggtttcatagaccgtgatttgagaaacacccagtatatcagcaagaaagcctttgcaatgctcaatgaaatttctaggcgcgtggtcgccactacaggctcaatcaccgacaagctgcgggaggattggcagctagtggacctgatgaaagagctcaacctgccgaagtacgaaaaacttgggatggttgagatgttcgaagacaaggatggaagaaagattaaaaagatcacggactggaccaaaaggaatgatcaccgacatcacgctgtggacgcgttgacagtagcatttactaaggatgtcttcatacagttttataacaataaaaacgccgcttggatgcccgccagtaaggagcatgcaaatattaccggcatcaaggcccgctacttcgagaacggtaaagctctggcccctatgccattagcacaatttcgggcggaagctaagagacacctcgagaatctgcttgtgagcattaaagccaagaacaaagttatcacatccaatgtgaacaggactaagaacaagaatggggaaaaccgtaaactgcagcagacccccagaggccagttgcacctcgagacagtctatggatctcatcggcaatacgcaaccaagatagaaaaagtgaatgccgctttcgacgtaactaagatcgccacggtgtcgaaactggcatacagaaacgctctactgaagaggctcgaggcctttggcaatgatcctaagaaagcgttcacagggaagaacaccctggagaaaaatccactttatttggacgaaaaccagactgagatggttcccgaaaaggtccagaccgtggagtttgaaacagtgtacaccattcgaaaaccgatcgatcctaatctgagcattgacaaggtcgttgatgtgaagatccggtccgtgttagagaaacgcctcaaggagtatggaggtgacgccaaaaaggctttcgtaaacctggatgaaaatcccatatggcttaacgaggcaaaaggcatttcaatcaagagagtcagtatcagggggatttctaatgcccaaagcctgcacgagaaaaaggacaaggacggaaacctaatcctcggcaaagaaggtcggaagattccagtggattttgttaatactgggaacaaccatcacgtggctatatacaaaaagcctgtcctggacaaagtgggccaggttgtgttggatgaagagggaaatcccaagtatgagctggacgaagtagtcgtgtccttcttcgatgccgtgacacgagcaaacttaggccagccaatcattgacaaggattacagacgctcagaggggtggcagtttctcttcagcatgaaacaaaatgaatattttgtcttccccaacgacaagacgggatttaatcctaaagaggttgatctgcttaacccagagaattacgcgctgatctctccgaacttgttcagggtgcagaagtttgcctacaaaaattatgtattccgtcatcacctcgaaaccactattaaggacacatccagtaccctgaagggtatcacatggactgattttcggagctctaaaggcctagacaagatagtgaaagtcagagtggaccacatcgggcagattgtttccatcggagagtactga

SEQ ID NO: 2891 - RNA, 3663 nt, synthetic construct
  misc_feature 1..3663: note = Cas9 variant
  source 1..3663: mol_type = other RNA
atgaagagaatcctgggcctcgaccttgggagcgcctccattggatgggctctgatagaggaagatgagaaaggtatcaggattatcgcattgggctctcggattatcccctacaacgggaccgaaggacaggacttcgccaagggcgcgggtgagtcacgcaatagtttacgaacacaagctcgtactacgagaaaagggtatgataggtaccagctgcggcgcaagtatctaataaacgtgctcgagaaaaatctgatgatgcctagcgaagaccttagaaagatgccaaagatgaacctgtggcagttgaggtccaaagccgtcaccgagtacatctctcggcaggaactcggacgcctgctgctctggttaaatcaaaagcgaggctataaatcgtcaagaagcgatgcaaacctggacaagaaagatacagactacgttaaggaggtgaagagtaggtttgataaaattaaggagaaaaatcagactatcggccagtatttctacgaatcccttcagtgcgacgagtactttcgggtaaaggaaaacgtgttcccgcgtgaggcctatattgctgaatttgatgcaatctgttctcgccaaaaagaccacttggggctgagcgaggaactaatagccgagattagaaatgagatcatttactatcagaggcccctcaagtcccagaaaggactggtctcagtgtacgatttcgaaggtaagtggatgaaccagaatggcaaggagctttttatcgggcctaaagttgctcataagagtagcccactgttccaattggccaaaatctgggaatctgtgaacaatattaagctctccaccaaatatggagacacaatagagctgaccttagaagagaagaagcagctggtcgagtttctcgacaacaatgaaaaacttactacagcggcactgttcaagatcttgcggaaagataagaaagagtacattctacccaagcagctggaaaagggcctccaaggtaacatcaccaaatgcaagatagccgacattctggggtcaaaatataaccagcttctgcagttgaatctcgagaagcaggaagtgggaacgccttgttacctgtacactaaaagcaccggcgaggtattaggcgagaagccactgcaatatatcgataagagtgttgaaaaagagctattttaccagctctggcacacaatctattctatttccgacgaagatgagtgctgtaaggctctgcagaaacgattcgacatcgatgccgagactgcagggcgccttgctaagattgactttagcaaatacggattcggtaacaagtcggccaaagcgataagaaagatcttgccctatctgatggaaggcgataagtactctgacgccatgtgctatgcagggtacaatcattccaactcactcaccaaagaggaaaatcacgagaggaagctgaacgataaacttaagctgttgaccaaaaatagtctccggcagcctattgtggaaaagatcatgaaccaaatgatccagctggtcaataccattatagacaagtacggaaaaccagacgagatccgcttagagctggctagagaactaaagcagagcaaagaggaaaggaacgatgccgacaaggctatgtccaaacgtcagcgggagaataaggaagccgagaagaaactcgaggaacatggcattcgagcaacgcacaacaatatcctgaagtatagacttttcgaggaaatgggtgagaaaaagcacgaagccatttgtatctactgcgggaacccgatatcttttagcgctgcgatgaatggcgatgaggtggacgtggagcatatcattcccaggtcaaaattgttcgatgacagtcaatccaacaagactctggcacaccgcaagtgtaacgccaataaaaacgatatgacagcttatgactttatgaagaccaaaagcaagcaggatttcgacaaatacgtcgaacgggttaatcagctctatgccgatagaatcatttctaggtcaaagtacaacaaactgttaatgagtgaggacgatatccctagcaattttatagaccgccagctgcgagaatcccaatatattgcaactaaggcccgggagatccttcagacaatttgctacaacgtgtggtctacctcgggaacggtaaccgctgagttgcgtcatctctggggctgggacgatatcacaatgaatctgcagatgccaaagtacaaagaactagggctgactgagatggtggaatggaccagcgaccacggaaagaacgtccactccaaagaggtgataaagggttggacaaaaagagatgaccataggcaccatgccatcgatgcactcactattgcgtgtaccaagcaaggcttcatccagcgctttaatacactgtcaagttctaagacccgggacgatatgcagaaagaacttgagaagtgcagcattcagttcagagagaaaaggtccttgctggaaaagtatatcatatcacaacgacccattagcgtttctgacgtggctgaggccgtctcccgcatcttaatcagttttaaagcagggaagaaggtggccactattggaaaacggaaggtaaaaggcaaggttgtgcagcagggtatcgtcgtgcctagaggggctctcagcgaaggctctgtctacggaaaaattaggacgatagtgcgtaagatgccagttaagtatctgttcgagaaccccgatcttatctttaaaccgtacattaaggccctggtgaaagaacgcttggcagagttcgacaatgataacaagcaggctctcgcctccctgaaaaagaatcctgtatatctagacaaggagaaaacaaagctgctcgaatacggcacatgctttaaagatgagtatgtcaagaaatacgacgtgaaccccaatttcactaagatcgcggacgttattgatgggaaagtgaagcaaatcctggaagaccggctttcaaagttcggaggtaaaccaaaggaggcctttaaagatgtcgtgaaggacggcaaaaccttgaagtggtacgaagatgaggggctggagagacctataaggagtgtacgatgtttaacaggactcagcgctgtggttcccgtcaagaaagacgaaaacggcatggatatcggtttcgtgaagccagggaacaatcaccatgtggcaatttatgtcggcgccgacggaaaaggccaggagcacgtttgcaccttttggaacgctgtggaacggaagaaatacgggctgcccatcattatcaaggatgccaatgaggtgtgggacaagataactatggcaggagatgacgtatatcctcagtcgttcctttccctgctaccaaaaccggactggacactcaagctgtctatgcagcaaaacgagatgtttattttgggcatggaagaggatgaagtcaaattcgcgatcgagagcaaggactacaaactgttatcagatcacctctatcgcgtgcagaagctgagttcctctgactacaattttatccatcaccttgaaacggatgttcagaagaaaaccatgacttatagagtgaggagcctgtccggtttgttcgccctccggccctttaaggtccgaattgactgtctggggaacataatcccttcatga

SEQ ID NO: 2892 - RNA, 3669 nt, synthetic construct
  misc_feature 1..3669: note = Cas9 variant
  source 1..3669: mol_type = other RNA
atgaagaaaagaatcctgggcctcgacagcgggaccaactcccttggatgggccgtggtcgatagggacgagaataaccagtactctctgattaagtatggtgatttgatattcgaagagggcgttaaaatcgaaaagggggtggagtcaagtaaagctgcagaacggacaagccaccgcgccttacgaaagctgtactttcgtagaaggctacggaagattgaggtactcaaagtgctggtcaagtataatctttgcccccaagtgtccgaggaagaactgcatttgtggcacactcgcaaactctaccctcagaacaaggacctgctgcagtggcagagaacggatgaaaaagcgggaaagaatccatatatctacaggtatcggtgtctccatgaggagttagacatgtctgtttcggctaaccgcatgaccgtgggccgagccatgtaccacctggcacaaagaaggggtttcctttcaaatcggttggataacgaagaggacgaaaatcagattggggccgtcaagtgcggaatcagcaacctgacagaggaaatacagagttccggctgtaaatacctaggcgagtatttttacaagctctataatgagcatgggaacactgtgcgtctgcgcaccagatacacatctagggagttccactataaaaaggagttttacgctatctgcgaaaaacagaaacttgataaaaagctgattgaggaattggcaagcgccctctatttccaacggccgctgaagtcccagcgacacaccgtaggacgctgtacttttgagcccaataaacctagatgcgctgactcacatccagcctacgaggagttcaggatgttaagttttatcaacacaattaaggttcagggtccctacgataccgaactgcgggtgctcaatacggaggaacgcgacagcatcactaaacttttctgtagaaagtctaaacctaactttgatttcgaagacatagcgaaggagctggcaggcaggaacaattattgctacattggggacgtcgtggataaggcctataaatttaactaccgtatgtcccagggagtgtcaggctgtccaaccacaacttatttgatcaatgtcttcggtcaagactggcagaccgggattgctgagagctaccaggccatcgatacaaagctaggacaaaagagtgttgacgcaatgatcgatgacgtgtggaacgtactgtattctttctccagcaaggataaactccgggactttggccgaaagaagctgcagcttggcgataaagaagctgacaccttcgccaatattaagctgacgcacaaatttgcgtcgttgtctctcaaggccataagaaaaatcaacattttcctgaggatggggttagtgtactcccatgcagtcactctggctaatatccccacaatagtgggaaccgatatttggcagcgcaagcggaactttatcctagccgagctcctgcctcttatcgaaaatttcaacccaaaggagactaaattgcaggagacactggacttttgcgttaaggacttcctccaaaataactttgaactgaaaaatggtgctgtggataaactttaccacccgtcaatgattgaggcctatcccgacgcaggcctgaacagtaatgggatcttgcagctcggaagccctagaaccaacgccattaggaacccaatggctatgcgctccctgcacgaaatacgaaaagtcatcaatcagttactgaaggataaaattatcaaccaggacacggagatccatgtggaatacgcgcgggagctaaatgatgcaaacaagcgtaaggccatttctatatggcaaaagagccaggagaagctccacaaaaagtatgtagaagagatcaccaatctgtacaaagaagagacaggcaaggctattgttcccactgacaccgatatccttaagttcaaattgtgggaggaacagaaccatatttgtctgtatacaggtcagcaaatcgggatagccgagtttctcggcgcaactcctaagtacgacatcgaacacaccattccacagtcagtgggaggcgatagtacagacatgaatctgaccttatgcgattccagattcaacagggagatcaaaaaggcccagctgcccactcagcttgggaatcatgctgacattttggtccgcatcgccggatggaaaaacagctatgaaaagctctctaaggatatagaccggattagaacgcactcaggtatggcaaaagacatcaaggataggctgattcaaaaacgacacctactgaagctcgagcgcgactactggcggggcaaatacgaaagatttacaatgaatgagatcccggaggggttcagtaggcgtcagggagtgggcataggtctgatcagcaagtatgcggggctttacttgaagtccctgttccatgataaaaacgaacgcaataagggccacgtctttgtggttaaaggaaccactaccgctgagttccggaagatgtggggcttacagaacgaatatgagaaaaagtctagaaataaccatgtgcaccactgcattgacgccatcacaattgcatgtatcgggaaacatgagtacgcccaaatggctcagtattaccacgatgaagccgagtatctctaccatcacggaataaagcctatttttcccaagccatggaaaaccttcactgaagacctgcttgatctggagcattcgttgtttgtagtccaccacagccctaacaatatggcaaagcaggctaggaaacgaatcatcacatccacgggtcagcattgggcccaaggcgactcagcgcacgggagtctccataacgatacctactatggagccattgaacgggacggcgagatcaagtacgtggttcgcagagctgtgtctagcttcgagcagatgtccgatgtcgactcaattgtggatgacgtagtgaaagaaactgttaggaaggcactggagggtaagaattttaaagaagccgtcaacgctcccatatatatgaataaggagaaaggggtgctaatcaagaaagtgcggtgctacgccaagagcattaagaaaccaatcgacattcgaacacacagagattcttccagtaaggaatataaacgcaagttccatgtcagcaacgacatcaattacctgatagcaatctatgagggcaccgttaaaggaaaggtgaagagggattttgaggtggtcaaaaacattgaagcggccaatttctttaagcgttctcaggaccggagagattaccccacaatcgtacctgagaaatccattaagcacggcttcccactcaaaactaccctgacgaacgggaccatggtgatcctttacgaagagaataaggaagagatagactttacaaagaaagaggatatttgtaggcgcttgtataagctggttggaatgtcaagtatgatcgtgagcggctgcgaatacggtgtcttatcgctccgacaccatcaggaggctagaccgtccaaagacatcaagtctaaaaacggggccttcaagaatggagaagcactgcggcccgctattactatgcttcacacccaattcaacgccctggtggagaatatagattttaacatcgacgttacaggcaacattgagctaatctga

SEQ ID NO: 2893 - RNA, 3669 nt, synthetic construct
  misc_feature 1..3669: note = Cas9 variant
  source 1..3669: mol_type = other RNA
atgaagaaaagaatcctgggcctcgacagcgggaccaactcccttggatgggccgtggtcgatagggacgagaataaccagtactctctgattaagtatggtgatttgatattcgaagagggcgttaaaatcgaaaagggggtggagtcaagtaaagctgcagaacggacaagccaccgcgccttacgaaagctgtactttcgtagaaggctacggaagattgaggtactcaaagtgctggtcaagtataatctttgcccccaagtgtccgaggaagaactgcatttgtggcacactcgcaaactctaccctcagaacaaggacctgctgcagtggcagagaacggatgaaaaagagggaaagaatccatatatctacaggtatcggtgtctccatgaggaattagacatgtctgtttcggcgaaccgcatgaccgtgggccgagctatgtaccacctggcccaaagaaggggtttcctttcaaatcggttggataacgaggaagacgagaatcagattggggcagtcaagtgcggaatcagcaacctgacagaagagatacagagttccggctgtaaatacctaggcgagtatttttacaagctctataatgaacatgggaacactgtgcgtctgcgcaccagatacacatctagggagttccactataaaaaggaattttacgccatctgcgagaaacagaaacttgataaaaagctgattgaagagttggctagcgcactctatttccaacggccgctgaagtcccagcgacacaccgtaggacgctgtacttttgagcccaataaacctagatgcgccgactcacatccagcttacgaagagttcaggatgttaagttttatcaacacaattaaggttcagggtccctacgataccgaactgcgggtgctcaatacggaggaacgcgacagcatcactaaacttttctgtagaaagtctaaacctaactttgatttcgaggacatagccaaggagctggcgggcaggaacaattattgctacattggggacgtcgtggataaggcatataaatttaactaccgtatgtcccagggagtgtcaggctgtccaaccacaacttatttgatcaatgtcttcggtcaagactggcagaccgggattgccgaaagctaccaggctatcgatacaaagctaggacaaaagagtgttgacgccatgatcgatgacgtgtggaacgtactgtattctttctccagcaaggataaactccgggactttggccgaaagaagctgcagcttggcgataaagaggcagacaccttcgctaatattaagctgacgcacaaatttgcctcgttgtctctcaaggcgataagaaaaatcaacattttcctgaggatggggttagtgtactcccatgccgtcactctggcaaatatccccacaatagtgggaaccgatatttggcagcgcaagcggaactttatcctagctgaactcctgcctcttatcgagaatttcaacccaaaggagactaaattgcaggaaacactggacttttgcgttaaggacttcctccaaaataactttgagctgaaaaatggtgccgtggataaactttaccacccgtcaatgattgaggcttatcccgacgccggcctgaacagtaatgggatcttgcagctcggaagccctagaaccaacgcaattaggaacccaatggccatgcgctccctgcacgagatacgaaaagtcatcaatcagttactgaaggataaaattatcaaccaggacacggaaatccatgtggagtacgctcgggagctaaatgatgcgaacaagcgtaaggcaatttctatatggcaaaagagccaggaaaagctccacaaaaagtatgtagaggaaatcaccaatctgtacaaagaggaaacaggcaaggccattgttcccactgacaccgatatccttaagttcaaattgtgggaggagcagaaccatatttgtctgtatacaggtcagcaaatcgggatagctgaatttctcggcgccactcctaagtacgacatcgagcacaccattccacagtcagtgggaggcgatagtacagacatgaatctgaccttatgcgattccagattcaacagggaaatcaaaaaggcacagctgcccactcagcttgggaatcatgccgacattttggtccgcatcgctggatggaaaaacagctatgagaagctctctaaggatatagaccggattagaacgcactcaggtatggccaaagacatcaaggataggctgattcaaaaacgacacctactgaagctcgaacgcgactactggcggggcaaatacgagagatttacaatgaatgagatcccggaagggttcagtaggcgtcagggagtgggcataggtctgatcagcaagtatgcagggctttacttgaagtccctgttccatgataaaaacgagcgcaataagggccacgtctttgtggttaaaggaaccactaccgcggagttccggaagatgtggggcttacagaacgaatatgagaaaaagtctagaaataaccatgtgcaccactgcattgacgctatcacaattgcctgtatcgggaaacatgaatacgcacaaatggcccagtattaccacgatgaggctgaatatctctaccatcacggaataaagcctatttttcccaagccatggaaaaccttcactgaggacctgcttgatctggaacattcgttgtttgtagtccaccacagccctaacaatatggccaagcaggcaaggaaacgaatcatcacatccacgggtcagcattgggctcaaggcgactcagcccacgggagtctccataacgatacctactatggagcgattgagcgggacggcgagatcaagtacgtggttcgcagagccgtgtctagcttcgaacagatgtccgatgtcgactcaattgtggatgacgtagtgaaagagactgttaggaaggctctggaaggtaagaattttaaagaggcagtcaacgcccccatatatatgaataaggaaaaaggggtgctaatcaagaaagtgcggtgctacgctaagagcattaagaaaccaatcgacattcgaacacacagagattcttccagtaaggagtataaacgcaagttccatgtcagcaacgacatcaattacctgatagccatctatgagggcaccgttaaaggaaaggtgaagagggattttgaagtggtcaaaaacattgaggcagcgaatttctttaagcgttctcaggaccggagagattaccccacaatcgtacctgaaaaatccattaagcacggcttcccactcaaaactaccctgacgaacgggaccatggtgatcctttacgaggaaaataaggaggagatagactttacaaagaaagaagatatttgtaggcgcttgtataagctggttggaatgtcaagtatgatcgtgagcggctgcgagtacggtgtcttatcgctccgacaccatcaggaagccagaccgtccaaagacatcaagtctaaaaacggggctttcaagaatggagaggccctgcggcccgcaattactatgcttcacacccaattcaacgctctggtggagaatatagattttaacatcgacgttacaggcaacattgaactaatctga

SEQ ID NO: 2894 - RNA, 3678 nt, synthetic construct
  misc_feature 1..3678: note = Cas9 variant
  source 1..3678: mol_type = other RNA
atgagcaagagaatcctgggcattgacgtggggaccaactccctcggatgggccgtcgttgataggacagactgcgataattacactcttgtgaaacggggtgacgtaatattccaggagggcgtgaacatcgaaaaggggaatattgagaaatctcgcgcttcagaacgaacgggacaccgtagtaccagaaagcattattttaggcggcgcatgctgaaaatcaaggtcttggagattttagtggaacaccaactgtgtccctacctaagccatgaggagctccaccagtggatgacaagaaaggtttatcctactaacgaagatttcaggctgtggcttcggaccaatgacgcaaacgatcagaatccataccatgaccgccacgtgtgcctgcacgagcgattggatctcagactgcaggaaaacaggtatcggctgggccgtgccctctaccatttagcgcaacgcagaggttttctgtccaataggcttgagcagaactctaaaacagacgagaccggggctgtcaagtcggatatctcacagttgaatgaagagatgaaaaaggccggaagccagtatctgggcgactacttctactggctatatcaagaatacggcaaccaggtgactctccggatacgatatacagatcgcaaacagcactaccagaaggagtttgaagcaatctgtcaaagacagcagctgagtgacgaccttgtagataagctgaggcgggccatttatttccaacgctccttgaaatctcagagagctggggttggaaagtgcacctttgagccggacaaacccaggtgtgcactcagccatcctcgttacgaggagttccggatgctgtcctttttaaataacgtgaaggtcaaaggtccatcagatgacagtctgcgacccctcagcccttctgagaaggaaaagatcaagccacttttcctgagaaagtccaaagccaattttgatttcgaggacattgctaaggccatcgcgggcaaagggaagtatgcatgcataagggataaagaaggagcccagaagccctaccagtttaactacgctttgtcacaaggcgtgagcggttgtcctgtgacggccaagctaattgcagtcttcggggagagttgggagcgcaacctggttaatgcttatcggtctagaaacgacatgaggaaatccgatgaagagatcgtgaatgaagtatggaacgtgctctacagcttctcgtctaaggagaaactgcgcgcctggggaatggaaaaacttggcctggacgaggcgtgcgccggcgagtttgcagatattactttgccaaccgctttcgccgctctctccctgaaagccgtcaataagatcttaccgtttctgcgacaggggttcatctattcacacgcagtgatgctagccaacattccctacataatcggaatggaccggtggaatgaacctcgtcagagacagtttattatggacaacctccaagagctgcttgataatttcacagctagtgacaaggcgttgcagcagactctggatttttgtatcaaagacttcctcctgaacaattatgaacttgcaccaggtaaggccgataggctgtaccaccccagcatgatagagacctatcctgacgctaaagccgatggccaggggatttaccaattgggatccccagcaacaaacgccatccgcaatcccatggctatgcggtctctccatatcctgagaagggttgtgaaccagttactgaaggagaaaaccattgacagcgaaacggaggtccacatcgaatacgcccgagagctaaatgatgcaaaccgccggtgggcgattaaccagtggcagagaaagcaagaaactcagaggaaggactatgctgagaaaatacgtaaggtgtacgccgatgagtttgaaaaagtaatcgagccgacacaggaagaactcctgaagtatcaactttgggaagaacagcagcatttgtgcctgtacaccggcgagcagattggtctcactgacttcatcgggcctaatccccgctatgatatcgaacacacaattccacaatcaatgggcggagacagtacccggatgaacctgacgttatgtgagagaacctacaataggacagttaaaggcaaccgaatgccttcccagctggcagaacatgagagcatacttactcggatcaagccctggaaagacaagtatgaagagttgaccgtgaagattaataaactccgcacacacccagggatggataaggcctctaaagacaacatcattagaaagaggcatctgctagagctggaacgggattactggtttcagaaataccagcgattcactatgaccgaggtccccgaaggattttcactcagacaaggtacaggcatcgggctgataggaaagtatgctggccttttcttgaagagtctgttccaccacgtgaaagagcgcaataggaagcaggtctacgtgatcaaaggtcctattaccgccgagtttcgtcggttatgggggctccagaacctgtatgaacaaaagagcagagacaatcatgcacaccactgcatcgatgctattgttatcgcctgcataaacccagcggagtacgccaggatggcttcctattaccgccaggaagaggacttccgacttaataaaggcaacaagccggtgtttcccaagccttggactacgttcacacaggatctgcaggcattggaagccgagctcctggtagtccatgagaccagaaataacctaactaaaaaggctcggaaaagggtgcgcaccaagggaggcaatgttctgtctgaatcggacagcgcccgtgggtccctccacaacgatacatattacggagcaattcaaaaagacggtgtgatcagatacgtcgtgcggaaggcgctgtcaagtctttctgagaaggatgtaaaagacattgtggataagaccgttagggaaaaagtccaggccgctatccaggagaagggcgccaaagaagcattggctgggactatatatatgaacgaggagaagggaatcacaattaaaaaggtgcgctgttttacgaagatcgccagcccactggcaattcgaagacatcgggacgcctccgctaaagaatacaagaggccctattacgtgaccaatgagtcaaactatgtcatgggcatctacgaaggttgcataaaagagaagactaaacgcgagttcattttagttaataacctcgaggcggtgagacagctgaaggccgcaaggaagcaaggggtggtaagctctatccttcctccagtctccgctaaaagtcagtttcccctgaagtatcggctatacacaggcaccctcgtgctgttgtacgagaatagcccggaagagatcgacttcacaaaccaggttgatatttgtaaacgtctgtataaggtgactggattatcttccatgaccgtcacgggcaatcagtacgggaccatccaactccgctatcaccaggaagcccgacaggccaaagacctgaaggctcagaacggagcatacaaggagggcgaggaacatagacctgccattatgatgcttcacacacaatttaaagcgctggtggagggtactgatttcaggatgaatatattgggggaaatcgagccactccggaagtga

SEQ ID NO: 2895 - RNA, 3690 nt, synthetic construct
  misc_feature 1..3690: note = Cas9 variant
  source 1..3690: mol_type = other RNA
atgggcgacagaaagtacaacctggggctcgatatcggaaccagctccattggtttcgccgctgtggacgagaataaccagcccataagggtcaaaggcaagacagcaatcggggttcggctttttgaagagggaaaaactgccgcggatcgccgaggcttccgtacgaccagaaggcggctgtctcgcagaaggtggcggattaatttgttaaacgaaatctttgacgctcacctggccgaggtggatcctacattcctagcacgcctcaaggaatcaaatcgaagtaacctggacccgaaaaagagctttcaaggttcccttctgttcccagagagaaaggattatcagttttacgaggaatatcccactatttaccatttgaggaaagccctcatggagaaggaccggaaattcgatatccgtgaaatatatctggctgtacaccatatcattaagtaccgcgggaattttctgaacggaacccctatgagatctttcaaagtggagaatatcgagctcaacacattatttgaccagctgaatcagctttatgcagaaattgtcccagataacgagttggccttcgacctggctcaagtggccgatgttaaggacgtgctatcgtcaaccactatctacaagatggacaaaaagaaacagctcgtcaagatgatgctgcttcccgcgagcaataaagcactgcagagtgaaaacaagaaaatagtgacacagtttgtaaatgccattttgaactacaagttcaagctcgatgttctgttacaagtggagaccgacgctgattggtccctgaaactcaacgacgaaggcgccgatgacaaacttgaggagttcacgggcgatctggacgaaaataggttggagatcattgatctactgcagcggctccacaactggttttctctgaatgaaatcactaaggacgggaacagcctttccgcagctatggtcgagaagtatgaaaatcatcaccaccatctgggattgctcaaaaaggtgatcgagaaccaccctgatgccaagaaagcgaaggccctgaaagagacctacacagcatatgtgggtaagactgacgacaaaacccagaatcaggatgacttctacaaggctgtcgaaaagaacttagatgactcaccagatgccaaaggcattaagcgactgatacaactagaccagtttatgcccaaacagcgcacagggcaaaatggagctatccctcatcagctccaccagcaggagctggatcaaattatcgaaaagcagagtaaatattacccattccttgccgagccgaaccccaatgttaagagaaggaaggacgcaccttataaattggatgaactgatagcctttaagattccatactacgtgggccccctcgtaacccctgaggagcaggctcagaacaaagaaaatgtgttcgcgtggatgaagcggaaagcagccggtccaatcacgccctggaactttgacgagaaggtcgatcgcatggaaagcgctaatagattcatcaggcgtatgactacaaaagacacctatctgtttggggaggatgtgcttccggccgagtctatgatttaccaaaagttcgttgtgctgaacgaattgaacaatctcaagatcaacggacggcacctgtccttaaaagacaagcaggacgtctataatgatctgtttaaacagcagaagactgtgtcaattaaagcactacaaaactactatgtaacaaagaagaaagccgctaccgcccctacggttggcggcctcgcagaccccaagaaattcctgagcagtctttctacctacatagattttaagaatatgttcggggagcgagtgaacgacccacagttccaggaagatttggagcagatcgtcgaatggtccacaatttttgaggacagaggaatcttcaaagcgaagctgcaagctctcggttggctgagcgagaagcagatccagcaattagtggccaaaaggtataagggctgggggcgcctgtcgaaaaagttgcttactggactcaaaaatgcagaaggctactctattctggatgagatgtggcggtccaccgaaaactttatgcagatacagtcaagacctgagttcgccgctctaatccagcaagccaatgaaaagcagtttgagggtaacgaccccgataatgtctgggagaacattgaaaatatcctgggggacgcatacacaagtccacagaacaagaaagctattcgccaggtggttaaggtggtacaagatatcgagaaagccgtcggcaatccccctgaaaagatagcgatcgagttcactagggaagccgctgcaaacccacagcgaacccagagccggctccgtacactggagaaactttatgagtccgccgaagaggtggttgacgctggattgaccgccgaactggcagagtttaaggagaacaaacatgtgttatctgataagtactatctctacttcactcagctgggcagagacgtctatacgggggacacaattagccttgataagctgaatgactacgatgtggaccacatcttgccgcaatcatttattaaagatgacagtctcgataacagggtactgaccatccgcgcggtgaataacggaaagtccgacaatgttcccgccaaaatgttcggtaagaaaatgggcagcttttggcggcatctactggataacgggatgatatctaagagaaagtataataacctcattactgaccctgataatatctcaaaatacgctcagaagggattcattaacaggcagctggtcgaaaccagtcaagtgatcaaacttacagccaatatattgaacggcatctacgacaaggacaccgagattatcgaagtgccagcaaaaatgaatagccagatgcgaaagatgtttgatctggtcaaggttcgcgaggtgaacgactatcaccatgctttcgatgcctacttaactattttcatcggtaattatctctacaaatgctatcccaagctgcggccttactttgtgtatgacaacttcaaaaagtttgggaacaaagaagatataggccacaagagattcaattttcttggaaagattgagagggagaaaaaggtagtcgcaccagaaacaggcgagatcctgtggtccaacgtggcccccaatgaaacgatcaaacagattaagaaagtttacaactacaagttcatgatcgtgtctcgtgagattaccactcgccgggctgaactatttaatcagacagtctatccgaagaactacagagggaaactcatacctatcaaggaggacaggccaaccgatctgtatggaggttactcgggcaatacagacgcgtatttggccattgtggcactggaggataaaaagaaagggaagtacttcaaagttgtgggaatccccactcgagctgccgccaagttagaaaagctcaaacaacaggacagccagcagtatctgcaagcacttcacgaggtaattgctcctcagtttaccaagtccacgaaaaagggcatcaaaaagaccgagttcgaaatagtcctggataaggtgcattaccggcagttggtgcaggacggtcccgtcaaaatgatgctcgggtcaagtacatacaagtataacgccaaacaactggttctatctgaaaaggcgctgtga

SEQ ID NO: 2896 - RNA, 3696 nt, synthetic construct
  misc_feature 1..3696: note = Cas9 variant
  source 1..3696: mol_type = other RNA
atgatcaccaggattctgggcctcgacacagggactaacagccttgcctgggctgtggtcgatagggacgcaaatggaaactacacgctggttaagcggggtgatgtgatattcaccgagggcgtaaaaatcgaaaaggggattgagtcctctaaagccgcggaacgcacagctcacaaggccttgcgagtgcattattcacgtagaaggttacacaaaatcgacactctgaaggtcctagtggagctcgatctgtgcccctaccttagtaatgaacagctgaacttgtggaaggccaaaaagacctatcctctcacagacgattttatgctgtggcaacggagcggatccgcagaggagaataacccatactattgtcgccatagatgcctgacccagaaactcgacttaactgatcagtctcagaggttcctgcttggccgggctttttaccacttggcacaacgccgaggtttcctgtcgaatagactagacacatcagccgatagcgacgaaagtgggaaggttaaatccggaattgctgagctctctgtggaaatggagaaggccggctgtgagtttctgggcgaatatttctaccagctttacaagcagcatgggaacaccatcaaactgaggagccggtatacggatcgtgaggaacactacaagaaagagtttttggcgatatgcgaaaagcaggagctcgacccgaaatgggtcgaggcactgcaacgcgccatctatttccagagacccttaaagtcccagaggaaaggagtgggtaagtgtacttttgaacctaagaaaccacggtgcgctgagtcacaccccgactacgaagccttccgaatgctgtgttttctcaataacgtaaagattcagacccctaatgatacaagtcttcgcccactgaacgaggacgaaagagagaaaatctggcccttgttctttagaaagagcaaacctaatttcgatttcgaggacattgcaaaggctctagccggcaagaacaattatgcgtggtacaaagatgccggggaaaagccatttaaattcaactatcggatgcaacagggagtttctggctgcccggtgactgcacagctgatcgacatatttggttccgattggcaaaccgctattgccgagacatacaccgctgtcgaaaagaaaaacgggacgaagactatcgacgagatggccgatgacgtgtggaatgtgctctactcattcagcagtaaggataaactgaaggcatttgccacagaaaaacttcagctggacgaggcttctgcgaccaagttcgcaaacgccaaattgccccatggatttgcttccctcagcctgaaggccattcgcaatatcttacctttcctgagacagggctttatctatgcacacgccgtccatctagctaagattccagacatagttactaaagccgtgtggaacgatgcagacaagagggagatgatcctctcgggcctgatggaaattatcgagaattacaaccccaaagatcgtggggtagaaggaacaatagacttctgtattaagtctcaccttcaggatgtgatcgacttgcggcctggtgcggctgatgccctgtatcacccatccatgatcgagacctaccccgacgcaaaactcaataagatgggcgtctttcaactggggtcaccgcgaacgaacgccattagaaatcctatggctatgaggagtcttcatatcctgcgcagcgtggttaaccagttgctccgggatggaattatagacagaaataccgaggtgcacgtcgaatatgccagggagctgaacgatgcaaataaacgcaaggctatcgccgactaccagcgagaacaggagaagaaacggaagcaatatcgtgatgacattatcgcgttatacaaatccgaatgccataaggagatcgagcccacagacactgatattctgaaattccagctatgggaggaacaggaccacctctgtctgtacaccggcacacagataggtatctgcgattttcttggggacaacccaaagttcgatattgaacatactgtgcctagatctgtaggcggagacagcacccaaatgaatttgacactgtgcgatgccaccttcaacaggcaggttaagggcgctcagctcccctcacagctgagtaaccacgcagacatcttagtgcgcattgatcactggaaatccaagtgtgaggacctgcggaaacaacttgataagatcagaacttatgggggaatggaaaaagccatgaaggacaggttgatacagaagcgacatcgcctcaaaatggatctggactactggcagggtaagtatagccggtttacgatgacagaggtcccagagggcttctctagaaggcaaggggctggaatcggcctagtgtcaaaatacgccggtctgtttctcaagagtctgttccacaatgaacagaaccccaataaaagcaacgtctatgtggttaagggggtgaccactgcagagtttcgtcgcatgtggggccttcagggagaatacgagaagaaatcccggttgaatcattgccaccactgtattgacgcgatcaccattgcctgcatcggcaaggctgaatatgataaaatggcccagtactaccatgacgaggagctgttccaatggagagggacaaccactaagcctcactttaacaaaccatggccgacattcacggaagatgtattagcaatagagcagtctctcctggtcaagcatcttaccaaagacaatatgcccaagcaggctaagaaaagggtgcgaactgccacaggaaagtatctggcacagggtgataccgcccggggctcgttgcacaaagacacatactatggggctattgaacaagatggagagatccgctacgttctcagaaagcctctgaacaaatttgagaatgaagcggagctagaaaagattgtggaccaggccgtcaaggagaaaatcaaggaagcaatagctggcaaaaacttcaagactgccatcaccgagccaatttttatgaataaagagaagggtatcaggattaacaaggtgcggtattacgtaaaagcccaggaacgactgaagatcagacagcaacgcgatctcagctccaaagagtataagcagttcttttgtgtggaaaatgagtcaaactacctgcttgctatatacgaaggggagttgaaaggcaagaaggagagggacttctgcgttgtcaataacctggaaagtgcagcctgtttaaaacgttctaacaagggaaaagcggctcccctcgtgcctgagcggagcgaagagagaaatctgccacttctggccgtgctaaagaggggcacgcaggtcctcttctatgaaaactcccccgaggagattctgtttgataatccgcaagacttggttcgccgactgtacaaagtgaccgggatcaacacaaagaaggacgtgaaaaatggaaagacttatttatacggcaacatcgaactcagattccatcagaatgcacagaaaaaggatgacgtaaaaatgcagtcaggtgtctataagaacaatgaggtgctgcggcaagggattgttcttagccacaaacagtttaaggccctggtggaaggagtcgatttcgagtttaacgtgttgggcgagatcaagaaaaaggaaaggcacgcttga

SEQ ID NO: 2897 - RNA, 3699 nt, synthetic construct
  misc_feature 1..3699: note = Cas9 variant
  source 1..3699: mol_type = other RNA
atgaccaagacaagaatcctgggcctcgacactgggacgaacagccttggatgggccattgtggatagggacgaggtctccggtcagtacgaactggttgatcggggcgacttgatattcaccgagggggtgaaaatcgaaaagggaattgagtcttcaaaagctagtgaacgcacacaacaccgagcattacgtaagcagtattttagaaggcggctgcgcaaaatcgaggtactaagagtgctcactttctaccatctgtgtccccctgtcagcgaggaagaacttcacctgtggcatgtgaagaagatttatccagttgaaaatcacgagtttatgatctggcagaggaccaacgataatgagggcaaaaacccgtactattaccggcatatatgcttgcacacaaagctcaatctgaccctgatgaaagaccgctatatcctcggtcgagccttataccacctgtcccagagaagggggttcctttctaaccggttggatcaatcgcaggacgaagatgacaagggaactgtgaaaacaggcatttcaagcctgagtaaggatatgaatgacgcgggctgcacctacctaggggattatttttacaagctctattccgagaacggaaatcgtgtccgcatcagaaaccattacacggctaggaatgaacactatctggccgagttcgaagcaatttgtcaggtgcagaaacttgagcccgagctggtagaagccttgcggcgagctatctttttccaacgccctctcaagtctcagagaaaaggtgttggcaagtgcacttttgagccaaggaaaccccggtgtgcagacagccatcctgactacgaagagttccgcaagctgtgctttataaacaatattaaaatccagacctccgatgacgatacaatgagaccattaaacaaggaagagaggcagcgtattaattcactgttctatcgggtgagtaaggccaacttttacttcgaggaaatcgctaaactccttgggggacgaaacaattactgttatttcaaggacgaggtccaaaaagattttaagttcaactacagaatgagccagtctgtgtccggctgccccactaccgcccagctgaggaatatctttggtgaagactggaaaacagggattgcggagacctatcaacactcagcaaagaaggatggcagcttgaaaacggtggacgaaatggccgatgacatatggaacgtcctatacagtttctcttccaaggattgtctgtataattttgctgttaacaaactccagctggaggaggacaaggccaaaaagttcagcaagatcaaactttcgcacggatttgcatctatttccctgaatgctatccataagatattgcctttcctccgcatgggcatgatttactcacacgccgtgctgtttgcgaacatcccaactatcgtagggatggacgtgtggaatgatgaaagtaaacggcagcatattatgacagagttaagcgacctggtcttcaactatgatccgaagaatagagaagtggagggaaccatcgagatgtgcattaaagactttctactcaacaattacgatctgcccgccggtgcagtttgtaggctttaccacccttccatgatagacacttatccagatgctaaggccaacaagtacggcgtgttgcagctggggtctcccgctacaaatgccatccgcaaccctatggcaatgcgaagcctccatgaactgcggcacgtcgtgaaccttctgttgcgtaaaggaaagattgaccaaaataccgaggtacacgttgaatatgccagagagctcaacgatgctaataaaaggaaggcgatcgcagaccgccagcgggaactggataaattacataagaaataccacgacgatatcattacgctgtataaggaggagaccggcaaggacataaacccaacacaggccgacatcctaaaattccagctctgggaggagcaagaacatgtgtgcctgtacactggtagacagattgggatctcaaagtttcttggccccgatccggagttcgacattgaacacaccgtccctaggagtgtgggaggcgattccacacagatgaatatgactttgtgcgaccgacgcttcaaccgggatgtcaaaaaggctatgctgcccagccagctcccaaattatcaagagatcctgcctagaatagagaaatggaagaagaaatacgaaaagttaaccaaagacatcgatcactgtattacacattctgggatgaccaaggaggccaaagactcaatcattcagaagaggcaccgtctgactcttgaacatgattactggcgcaacaagtatagtcggtttacgatgacagaggtgcccgaaggattcagcagaaggcagggtgcaggcatcgggttggtttccaaatacgccggactctttctgaagtctctattccacgacccaaccgatcgacggcgctcgcatgtgtatgtagtcaaaggcactaccacagctgagtttagaaagatgtggggtctgcagagcgagtacgagaaaaagtccagggacaatcacgtgcaccattgcgttgatgccataaccattgcatgtatcgggaagaacgaatataataaaatggcgtcattctaccacgacgaagaggcttttgagcggggcgaatgcgagaagccccatttcgacaaaccttggccaacttttacacaagatgtgctcggactggaaaagcgacttattgtcgtgcacagtacgcaggacaacatgccgaaacatgccaagaaatatgtaagaactccccgcggcaagttcatcgcaaagggggattgtgccaggggatctttgcacctggacacctactacggtgctataaaacacaaggatgacacagagcctcgttatgtgttacggagagaactcagctcctttgattcagttaatgacctggatatcattgtcgacgatgccgtgagggagaaaatcaaggaggcagtgaaaggcaagagcgggaaggctttcaaagaagcccttgcgaacgtctacatgaataaggagaaagacattcgcatcaagaaagttcgatgctatgtgccatctgtgaagagacccatagacattcggcatcagagggatatgtcccgctttgactacaagcgtcaattccacgtagccaacgatggaaactatatgatggctatctacgaaggcgtcgtgaaaggtaagctgaaaagagacttcgagttggttaagaatatcgaagcagccagttattttaaagtgagccaggataacgagtctttctcctcaattgtccctgagaagagtagcaatgggtttccactcaaggctgtgctgaaaatcggcacccatgttctactgtacgaaaacacagcctcggagattgacttctccgatcccgtggacctcactcggaggctgtacaaggtagtcggactttctagcgcaataatcaataactgttcatatggctttattaccttgcgcttccaccaggaagcgcgacaggccaaaaatctgaagttaacgaaaggggtgtttaagaacgtggataattacagaggagctatcattctctatcacacccaactgaaggcccttgtcgagggctacgacttcgatatcaacatactgggtgaaatcacaagtaaacagtga

SEQ ID NO: 2898 - RNA, 3705 nt, synthetic construct
  misc_feature 1..3705: note = Cas9 variant
  source 1..3705: mol_type = other RNA
atgcccaacttctggagcatctttaccgagaatctgcagacatacctcatgaagactagaattttaggcctggacacggggaccaactccttgggatgggccgtggtcgatagggacgaaaataaccaatatacacctatatgccggggtgatttaatcttcactgagggcgttaaacaggaaaaggggattgagttttctctggctgcagaacgcacctcataccgagccagtcgtagacactatttcaggcggcgcctaagaaaagtggaggtactcaaggtgctggtcaaacataaactttgtccaccgctgagcgacgaggcgttgaataggtggcacacaaagaaagaataccccctcgatgaggactttatcctgtggcagcggaccaacgaagctgataataagaacccttatcatgaccgccacatttgcctgcatcgaaaactcaatttaaaggattcccagactgacagatacacactgggaagggccctttatcacttgacccaacggcgtggcttcctgtctaaccgcctagatcagaatgaggaggcagaagagacgggtaaagtgaagtcggccatctcagaactcagcaaggagatgaaagaagctgggtgtgagtttctgggagactacttctaccttctgtatagaactgagggcaacagggttcggatacgaagtcgctacaccgatagagaaaagcactatttgcaggagtttaaagaaatctgcagggtgcaggagctcgacgaagacctggcaaaggccttagagaaaacaattttctttcaacggccactgaagtcccagcgccagggcgtcgggaaatgtactatggagaagggacattctagatgcgctgtgagccaccccctctacgaagagtataggcttctgtgttacttgaataacatccgtattaagaccccttccgatgaccggctacgaccactgaatgccgaagagagagaaaagatcacacccctcttctataaggagaaaaactttgatttcgagaagatagcgaaaaagctggcaggtaagacccctttcggctggattagggacgccgaagattggccataccagtttaactaccgcatgacgcaagaggctccggcctgccccactacagcacagcttatcaaagtattcggggaagactggaaggctgccctggcggagacctatactatgtcagccaaacaggatggaacattgaagaccgaggacgaaatttgtacggatatctggaatgttctctacagttttagctctaaagagaagctgaaggagttcggccttaaaaagctgcaactagacgaagtgcaggcaaaggctttttccgaaatccggctcaccagagatttcgcctcactgagccttaaggctattaggaaaatattgtttttcctgcgcacaggtgaggactatagtaaggccatctttctcgcaaacattcctactatcgtcggggaggaaatatggaatgacattgagcgacggtctcgtctgctttacaaggtggatctggccttgagaccacaggaagagagggacgctgaggaacatcgcaccatcgcggagcggatcaaagcagccgtggctgccgaagtccccgatgcacctattgacctcctgtatcacccatccatgatcgaggcctaccccgatgctaagagaaacgaaaggttcgactgctatcagttaggaagcccgaaaacaaatgccgttcgaaaccctatggcaatgcgctcgctgcacatggtgcggaaggtaattaatcatctactcagaaaacacataatcgatgagaagactgaaattcatatcgagtacgcgagggagctgaacgacgctaataaacgtcaagccatcgcagattggcagcgcgaactttctaagcggcacaccgcctacgctcagaacattagacagttgtataaggccgagacaggcctggtgatagaacccaccaaagcagacatcctcaagtaccaactgtgggaggagcagcagcatgtctgtttatatactggcaaaaagattgggatcgctgattttctgggagccaatccaaaattcgacattgaacacacgatccctaggtcccgaggtggcgattcaacacaggagaaccttaccttgtgcgaaagtaagtttaatcgggacataaagcgcgacaaactccccactgagctggcgaactacgaagagatcctagccagaattgagcactggaagaaacaatgctatgctctgaagctcaaaagggatgggatccggacccatagcggactggaaaagtccattaaggactctcgaatcagacgcaggcaccttgtgggcttggagtacggttatctgaaagggaagtacgatcgtttcacaatgaaagaagttccagagggcttcagccggagacagggagcaggcatagggttaatttcaaagtacgccggactctttctgaaaagtcttttcaaggaccccaagaatcctaacaggtccaacgtgtatgtcgtgaaaggtgctatcaccgccgaatttcgcaagctgtggggcttgcagcaggcagatgaggcgaaaagccgagagaatcatactcaccactgtattgacgcctacacaatcgcttgcatagggccatgtgaatatgccgcactcgctgcctactatagatctgatgaggagttcaagtacggacggaggcgcgaaaaaccgcaatttgaaaagccctggcctacgttcaccgaggacctgctaaaactgcaggaggaactcctgatcgtacatcagactacagataaacttggcaagcgtgacagacggaaagttaagaccccaaggggtaaatttttgacagggggcgattcagcacgcggacgactgcaccaagagacttattacggcgccattaactacgacgggaatatcaagtatgtggtcagaaaacccttagatagtctcaccgaaaaggacctggacaagattgtggatgagacggtcatgggaatcgtgaaaggtgctgttgaggcgaagggcagccttaaagaagccctggcagacgggatatacatgaacaaggagaaaggcattctaatcaagcgggtgaggatcttctccgatgtatctgaacctattaatctcaagcagctgcgcgacgtctcgaccaaagagtataagagacatatccacttgaggaaagatgaaaactacctgtttgctatttatgagggaatagacaagaaaaagaataagaaacagacagagactgccaccgtggattacttagacgccgctaagttctataaagatagcaagcggcgtgacaaagcaaactccctcgttggtgattactcaaagaagaataaactgccacttaagtgcatcctgaaaaagcgccagatggtgttgttttacgaacatagtcccgaggaaattcgattcaaagacaagaaagacctctctagaaggctgtatatcgtcacaagcattgccaaggatgggcgggtgaagtttctacaccaccaagcggctactgccaccggcatccagtcctcaccgagccctttcacgaacgacggagagcatcagccatactatcgcctgtctgcatccaatataaaagtacttgtggccggcatcgatttcgacattaacatcctcggggaaattacacccaagctgtga

SEQ ID NO: 2899 - RNA, 3711 nt, synthetic construct
  misc_feature 1..3711: note = Cas9 variant
  source 1..3711: mol_type = other RNA
atgtacttctataagaacaaagagaataagctgaacaaaaaggtggtcctcggccttgacctggggatcgccagcgttggatggtgcttgaccgatatttcccagaaagaagacaataagtttcccataatcttacacggtgtgagactgttcgagacagtagatgactctgatgacaagctactcaacgaaactaggcggaaaaagcgcggccaacgacgtagaaataggcggctgtttacgcgcaaaagagatttcattaagtaccttatcgacaacaatattatcgagctggaatttgataaaaaccctaagatattggtgaggaatttcatcgagaagtatattaacccattttcaaagaatctcgagctgaagtacaaaagtgtcaccaacctgccgatcgggttccataatctccggaaggctgcaattaacgaaaaatataagttagacaaaagcgagctgatcgtgcttttgtacttttatctgtccctacgcggagccttctttgataatcccgaagacacaaagtctaaggagatgaacaaaaacgagatagaaattttcgataagaatgagtcgatcaaaaacgcggaatttcctattgacaagatcatcgagttctacaaaatttcaggcaagatacgaagcactatcaatctcaagttcggtcaccaggactacctgaaagaaattaagcaggtttttgagaaacagaacatcgatttcatgaattatgagaagtttgctatggaagagaaaagtttcttttccagaataaggaactactctgaagggccaggaaatgaaaagagcttctccaagtatggcctttacgccaacgaaaatggcaaccccgagctgattatcaatgagaaagggcaaaagatctataccaaaatttttaagacattgtgggaatcaaaaatcggaaagtgtagttacgacaagaaactctatcgggcacctaagaacagcttctctgccaaagtgtttgatattaccaataagctgactgactggaaacataagaacgagtacatatccgaacgtttaaaacgcaagatcctgctctcaagattccttaataaggatagcaaaagtgctgtcgagaagattctgaaagaagagaacatcaagtttgagaacttgtctgaaatcgcatacaataaagacgataacaagattaatctaccaataatcaacgcctatcactccctgacaaccattttcaagaaacatctcatcaattttgagaactacctgattagcaatgaaaacgacctttcgaagctgatgtctttctataaacagcagtccgagaagttgttcgtgcccaatgagaaaggttcatacgaaatcaaccagaataacaatgtactccacatatttgatgctatcagtaacattctgaataagttcagcacgatccaagacaggattcggatcttagagggctattttgaattttccaacctgaagaaagatgttaagtctagcgagatatactcagaaattgccaaactacgagagtttagtgggacttccagcctctctttcggagcgtattacaagtttatccctaacctgatttcagagggcagtaaaaattacagcaccatctcctatgaagagaaggcacttcagaaccagaagaataacttctctcactcgaatttgtttgagaaaacatgggtggaggacctgatagccagcccaactgtcaagcgctccctcagacagaccatgaacctgcttaaagaaatcttcaagtactcagagaaaaataacctggagattgaaaagatcgtggtggaggtcacaaggagttctaataacaaacatgaacggaagaagattgagggtatcaataaatatcgcaaggaaaaatacgaggagttgaagaaagtttatgacctcccgaacgaaaataccacgctgttaaagaagctgtggctactcagacaacagcaggggtacgatgcttatagcctgaggaaaatagaggccaacgacgtgattaataagccctggaactacgatatcgaccacatcgtacctcgttccatttcatttgatgacagcttctctaaccttgtgatcgtcaataaattggataacgcaaagaaatccaatgacctgagtgctaagcaatttattgaaaagatatacggaatcgagaaactcaaggaggccaaagaaaactggggcaattggtatctgcggaacgcgaatggcaaggccttcaacgataaagggaagttcattaagttatacactatcgacaatctggatgagtttgacaacagcgatttcattaatcgaaacctttctgacacatcctatatcaccaatgcattggtgaaccatctcactttttcaaatagtaaatacaagtatagcgttgtgtcggtcaacggaaaacagacatccaatctgagaaaccagatagctttcgtgggtatcaagaacaataaagaaaccgagagggaatggaagcgcccagagggctttaagtctattaacagcaatgacttcctaatccgggaggaagggaaaaacgatgtaaaggacgatgttctgattaaagacagatcatttaatggacaccacgccgaggatgcttacttcatcacgataattagtcagtattttaggtccttcaagcgcatcgaacgactcaacgtgaattaccggaaagagacccgtgaactggacgatcttgagaagaacaatatcaaatttaaggagaaggcctctttcgacaacttcttgctgattaatgcattagatgaactcaacgagaaactgaatcaaatgagatttagcaggatggtcataacaaagaaaaacactcagcttttcaatgaaaccctgtactccggcaagtatgacaaaggtaagaacacaatcaagaaagtggagaagttgaacctcctggataatcgcactgacaaaattaagaaaatcgaagagtttttcgatgaggacaagctaaaggaaaacgagctgaccaaactccatatttttaatcacgacaagaacctgtacgaaacacttaaaatcatatggaatgaggtcaagatcgagattaaaaacaagaatttgaacgaaaagaattatttcaaatactttgtgaacaagaaactgcaggaggggaagatctcattcaatgaatgggttcccattttagataacgactttaaaatcatacggaagattagatatatcaaattcagcagtgaggaaaaggagaccgatgagatcattttctctcagtccaatttcctcaagatcgaccaaaggcagaactttagcttccataatactctgtactgggtgcagatatgggtatataaaaaccagaaggatcaatactgcttcatttcgatcgacgcccgaaactcaaaatttgaaaaggatgagattaaaatcaattacgaaaaacttaagacgcagaaagagaagctgcagataattaacgaggaacctatcctaaaaatcaataagggcgacctcttcgagaacgaagagaaagaactgttttatattgtcggacgcgatgagaagccacagaagttggaaatcaaatacattctgggcaagaaaataaaggaccaaaaacagatccagaagcccgtgaagaaatatttcccgaattggaagaaagttaacttaacatacatgggggagatttttaagaaatga

SEQ ID NO: 2900 - RNA, 3717 nt, synthetic construct
  misc_feature 1..3717: note = Cas9 variant
  source 1..3717: mol_type = other RNA
atgaccaaggtgctgggcctcgaccttggggccgctagcgtcggatgggcaatgatcgaggaagaggaaaaatcccacaagattctgggtttgggctctagaataatcccctacgaggggacagaaggaaacgatttcgccaaaggcactggtgagtcaaggaatgcgttacggacgaaggctcgcaccgcccgaaaagggtatgaccgttaccagctgagaaggaagtatctagttgatacactcgtgaagaacgagatgatgcctgacgaatacctgcggaaacttccaaagatgcaactgtgggagttgcgcagtaaagcagtaactaccgaaattacaaagcaggagctcggaagactgtttctgtggctcaatcagaaaaggggctataagagctcccggtctgatgccaacttagacaagaaagataccgagtacgtggtcgaagtgaagtcgcgccatgagaaaatcaaggaatcaggcttcactattgggcagtatttttacagcgagctgaaaagtaatgaatacttccgagttaaggagaacatctttccgagagaggcttatatagaagagttcgacgcaatctgcaaacaacagaagaggcaccttacagataagttgatttcccggatccgtaatgaaattatctactatcagcgccccctgaaatctcagaagggacttgtgagcgtctgtagatttgagggtttctttaaaaagggcataaacgggaaagaatacttcgtgggacctaaggtagccccaaagtcctcacccctctttcaaaccgttaaaatttgggagaatatcaacagtattaggctgagcgaccggaatggcaaggagatcatgctttctctggaacagaaaaagtgcatcttcaaccatttggataataacgagaaactcacgcctaaggacctgtttattataatcggtgtgaagaaagaaaattgtttcgtcaacaagcagttagagaaagggattcagggaaacgtgactaagtccaccatcctgaaatgcttcggcgaaaataacgattatgacaagtggctcaaacttgacctgaatataattgtgaaaaaggatacatttggctacttgtatgacaaaaagactggggagatcatcggagagaaactaattaagcacgtcgattcagctgttgaacgagagccactgtaccaactctggcataccatctacagcattaacaatacagacgaatgtagtgccgcgctgcagaacaaattcggttttgattctgagaccgcagacaaactttccaatatagatttcggcaaggccgggtttggaaacaagagcgctaaggtgatccgcaaaattctgccctatttgatggagggcgacgattactcgcagtctatgtcctatgccggtttcaatcactcagacagtctcacgaaggatgaaaacctgaaaagaaagttactggacaagctaaggcctatcgagaaaaatagcctccggcaaccaatcgtagaaaagattctgaaccagatggtgaatgtcgtgaacgcaataatcgacaaatacgggaagccggatgagattcgcatcgaacttgctagagagttgaaacagaataaggaggaaaggaacaagactgacaaagatatgtccaagcgtcagcgggagaacggcgaaatttctaaacgactggccgagtatggactcagagcgacaaggaataacatcataaagtggcgcctgtacgaagagatcgacaatcaagataaaaagctaaacgccatttgcgtttattgtggccagcccatcagcctgaccgaggcaattaaggggaatgaagtggacgtcgagcacatcatacctaaatcaaagttgtttgatgacagtcagtccaacaaaactctcgctcatcggagatgcaatagcacaaagggagatatgaccgcctacgacttcatggaaaacaaaccagctcaggtgtttaatgcctacattgagagggtaaacatgctgtatgataataagatcattcgcaaagttaagcgagacaagttactgatgcccgaatctaaaatccctgataacttcatagaccggcaactacgtgagtcacagtacatcgcaagtaaggccagagagattctccagacgatctgttataatgtgtggagcacctccggtacagtcactgctaggctgcgccacctttggggctgggacgatgcgaccatgtctttgcagctgccaaaataccgggaactcgggctgacagagatggtggaatgggagtcggagcatggaaagcaaaaacacagcaaggaagtcatttccgactggtcaaagagagatgaccacaggcatcacgcagtggatgccttaactatcgcttgcaccaaacagggctttatacagcgattcaacacactgaatagttctaagaccaaagaggacatggaatttgagattgccaagtgtagcatcgaatatcgcgagaacctttccaaattggagaagtacatcattgcactccggcccatcccggtttcagaagtggaggatgccgtagctaacattctgatcagcttcaagtctggtaaaaaggtcgccgtgaaagggaagagaaaaataggcaagaggggaaataagaaaattatccagactgacattatcatacctcatggctccctaagtgaagagagcgtttatgggaagatcaaaacgattgaacgtgagaagcccctgaaatacctcttccaaaactctcagctgatctttaataacaagattaagatccttgtggaggaacgcttggcaacattcgagaatgataccaaaaaggcgctggcttccttaaagaaggtcccagtgtacctcgacgaagagaaaactatagtactggaatatgcaacctgctttaaggaggagtacgtgaaaaagtatgatgttgacacaaacttctcaaagaccgataaagtcattgacgacaagatcaaagaaatccttcagcaccggctgggaaagtttggtggcaaagccaaggagaaggaagccttcaaagatgtgcaacagggggacaagactattaaatggtacgaggatgagggattggaaagacctatacatagtgtgaggtgctttacaggcctcagcgctatcgtccccgttaagaaagacgagaatggtattgatatcgggttcgtgaagccaggcaacaatcaccacattgccatctattcggacaaggatggaaaccgatacgaacatatatgtacgttttggcacgcagtggagcggaaaaagtatgacatccccgtagtcattaaagattccaatgaaatctggaacaagatttggtctaaacctgagggcagctacccacagtcattcctggacaagctaccgcaggagaatctgaccctcgatctgagtatgcaacagaacgaaatgcttatcttggggatgtcctacgaggacataaagactgctattgacaattctgattataaacagctgagctccaacttataccgcctccagaagctggccaacgcgaattatatgtttagacatcaccttgaaacacaaatcatcgacgataacaattcaaaagccagcaggcggttcattaacatccacagtctgaaggctctatttgcatggaatccctacaaagtgaacataaattgcctcggagacattcagaccaactctcgatga

SEQ ID NO: 2901 - RNA, 3720 nt, synthetic construct
  misc_feature 1..3720: note = Cas9 variant
  source 1..3720: mol_type = other RNA
atgaccgagaagagaaaattcgacatcagggaagtgtacctggccattcaccatatagtcaagtatcggggcaactttctcaatagcgctacagttgattccttcaaaacttctaacatcgactttacgtcacagttcgatcgccttaatgagctgtaccgacaagtgattttggaagaaccctttcagatcaacatgaatcaggtagacaagatgaccaacaaattactggataatgacgcactaaagctcgatacacagaagcaagtggccaaactgcttcctgtcatttataacgacaagccagtggataaacagtacactcgtctggcgaccgaatttagtaaggctatcttggggtataaaacaaagctcgacgttatactgaatctggatacccagaacgccaaggactgggcaatcagactcgatgacgaggacattgatgacaaattaccggccctggtggagaatcttgatgaaagcaggcaggagatcgtcactattatccgggacttgtacgctcaaataacactgaacgcaattgtgcccaagggaaaatccctatctgaatcgatggtagataagtataatgaccacaaagatcatctcgacctgcttatgggtctgatccacgagttgggcgatgactcagccaaggggattaaactccgcgaggcttacacccagtacgttggaaagagcggcgataagacgctgaaccaggacgacttttatgccgcgatcaaaaagaatttagatgaagacagtaaaagatcccctaagatccagaggctgattgagcaagcatctttcatgccaaaacagcggactagcgccaacggtgtgataccccatcagctccaccaacttgaactggatcgcatcattgagaaccaggggcgatactatcctttcttgaaggaaccaaattccaacacccacaagcccaatggaggcaaatacaagctagacgagctggtcgctttcagaatcccttattacgtgggcccactcataacaaaacaggatcaggagaagacttcaggggccgactttgcatggatgattaggaaaccgggacaaggtggcgaaatcaccccctggaacttcgatcaggaggtggaccggatggctagtgccaatacatttatccgtcgcatgaccacgaaggatagctatctggtcgcggaagacgttcttcctgattcttccctgatttacgagaagttcaaagtgttgaacgaactcaatatgctgaaggtaaacgacagaaggttatcaatcagccagaaacaggatctgttcaataacctatttaagaaacaaaagactattcggacaaagaaactccagacctacatacgaactaagtgggagctgccaagtgtgatgatctctgggctttccgaccccgacaaattcaatagctcgttggccacatatattgattttcgcgacgtcttcggagagaaggtggatgaccctaacagacaggcagattacgagaaaatcatcgagtggtctaccgtttttgaagacaggaagatttatcaggctaaactgaatcaactcgattggctgacggagtcccagtcaaaggcccttctgaccaagcattacacaggctggggtcggttgagtaaaaagctcctgactgggttaaaagaccagaacggagatagcatactggaccagctatggaagaccaatgataacttcatgcaaatccagtcccgcgacgaatttgctaaacagattcacgatgagaacgccaagcaattccatgaggcaaataacgtggacgacatcctcgatgacgcctttacatctccacagaataagaaagctattagacaggtcgataaggtggtacaggacgttgtgaaagcggtcggctatgcacccgataagatcgccatagagttcactaggagcccgcaagaccgtcctcagcggaccttttcacgacagagacagctgcaaagtacataccttaacgtggctaaagccttgatgaagtccaatctgaaccaggaactcaagagcgtcatcgattctcagcagaccctgactgacaaattatatctgtacttcacgcaacttggccaggatatgtacacagggaaggaaattaattttgacgagttggtgaactatcagatcgatcacattctcccccaagcattcatcaaagacgactcactggataatagggttctagtgagtgccccaataaacaatgctaagagcgacaacgtacctgtcaaaaagttcggagccaagatgggttacttttggaaacagctggcagagaatcacctcatttccaagcgcaaactgaacaatcttaccactgatcccgacaagatcggcaaattcaccgcgcaggggtttattcatcggcagttggtggaaacatctcaagttatcagactggtggctaacatattaggaaacgagtatggccacgatggtaccactatcattgaagtcacagccaagatgaatcatcagatgaggaaagacttcgatctcatcaagattcgcgacgtgaacgattaccaccatgcaatggacgcctatctgacggcttacgtaggggattatctttacctgcgatacccaaagttgcggtcgtattttgtgtacggcgacttcaaaaagctcaaagatcagagcctgaagatccgtaattttaacttcctacacgacctgaccaatgacgaggccggagataaaatagttgaccaggaaactggcgagattatctgggataagcacgagtccgtcaagcaactcaaaaaggtgtatcattacaaatttatgctggtgtcacaggaagtctatacaagacaggacgcacttttcaaccagaccatctaccccgctagtgatgccgacaagaggaaattgattcctatcaagaataacaagccagttgatgtgtatgggggatactctggtaatgtggacgcgtacatggccattgtacgcatacacggcaaaaaggaggataaatataaggtcgtgggggttccgatgcgggctgtggcagacctgaaaaaggccgaaagcaagggaagagataactacttaaatgctgtccatgaggtgctcaaaccccaatttacaaagaaaaagaaagacaggaagactggcgaaatcaccgagatgatggatgacttcgacgttctgcttggtaaggtgtattaccgacagctgattgtagatgggaacaaaaagtttatgctaggctcctcaacgtatcagtacaatgccaaacagctcgtcctgagcgacaaggcaatgcaagtgttgtctaaagatgacaagctgaaaaaccaggatgagaatcagaacttaatcgacgtgtatgatgaaattctcgagaaggtcgaccaatacttcgaactgtacgatatcaacaagttccgccagaaacttcacgacggacggaagaaatttatagagctgcctgttgataatgacttcaacggcaagaaattgatctcctatgggaagagagcgaccattatcagtattctcaatggactgcacgccaacgctacaatgagcaatctaaagtacctgggtatctcttccccatttggcatgcttcaggtgcccaacgggataattctcagtcctgcctcaaggatctgctatcagagcccaactggactgttcgaacgtaaagtaaagttgtcggacctgtga

SEQ ID NO: 2902 - RNA, 3738 nt, synthetic construct
  misc_feature 1..3738: note = Cas9 variant
  source 1..3738: mol_type = other RNA
atgatcatttacttcatatttgagaagatcgtgaacaccattctggtcatgaaaaagatcgttggcctcgaccttgggacaaatagcattggatgggccctgatcaacgcttatatagatgaatacaataaagagcacttgtatggtatcgaagcatgcggctccagaattatccccatggacgccgcgattttagggaacttcgataagggaaattctatctcacagactgctgacaggacgagttaccggggcatacgccgactgcgtgagagacatctactcaggcgggaacgcctgcaccggattcttgatctgttgggttttctccctaaacattatagcgactccctgaacaggtacgggaagttcctgaatgatatcgagtgtaagctcccatgggtgaaagacgagaccggatcttataagtttattttccaagaatcgtttaaagagatgttagccgatttcacagaacaccatccgaagctgatcgcaaacaataaaaaggtaccctacgactggactatctactatcttcggaagaaagccttgacccagaagatttcaaaagaggagctggcttggatactactcaactttaatcagaagcgcggctactatcagctgcgaggcgaagaggaagagacacctaacaaacttgtggaatactatagcctgaaggtcgagaaagtggaggatagtggggaaagaaagggaaaggacacctggtacaatgttcacttggagaacggtatgatctataggcggacttccaatattccactcgattgggaaggcaaaacaaaggagttcatcgtgaccacggacctggaagcagacgggtctcccaaaaaggataaagagggaaacataaagcgtagctttcgcgcccctaaggacgatgactggactttaattaaaaagaaaaccgaggctgatatcgacaagatcaaaatgacagtcggcgcctacatttacgatactctgctccaaaagccagaccagaagatcagaggtaaacttgtgaggaccattgaacggaagtattacaaaaacgagctgtatcagatattgaagacacagtccgagttccacgaagaactacgagataaacaactgtacatcgcgtgcctcaatgagctgtatcccaacaatgagcctcgcagaaactcaattagtaccagggacttttgtcatcttttcatcgaagatatcattttctaccagcggccacttaagagcaagaaatctttgatagacaattgcccgtatgaggaaaaccgctacatcgacaaggagtccggggagattaaacacgcatcaatcaagtgtattgccaaaagccatcccctctaccaggaatttagactgtggcagttcatcgtaaatttaaggatatatcgtaaggagacggatgttgacgtgactcaagaactgctacctacagaggctgattacgtcaccctctttgaatggctgaacgagaaaaaggagatcgaccagaaggccttctttaaatatccacccttcggatttaagaaaactacaagtaattaccggtggaactatgtggaagataagccttacccatgcaatgagacccacgcacagattatcacgcgacttggcaaagctcacattcccaaggccttcttgtctaaggaaaaagaggaaaccctgtggcatatcctctattccatagaggacaagcaagagattgaaaaagcgctgcacagctttgccaacaagaataacctttcggaggagttcatcgaacagtttaaaaatttcccgccttttaagaaggaatacggctcttactccgcaaaagctattaagaaactgttgcccctcatgagaatggggaagtattggtcaatcgagaacatagataacggaacaaggatccgcattaataaaatcattgacggtgagtacgatgaaaacatccgggagagagtgaggcagaaggccataaatctgactgacattacccatttccgcgctttaccactgtggctagcctgttatctcgtctacgatcgacacagtgaagttaaggacatcgtgaaatggaagacacctaaagatatcgacctgtatcttaagagcttcaaacagcattccttgcggaaccccattgtagagcaagtgatcactgagaccctgcgtacagtcagagacatttggcaacaggtgggccacatagatgaaatccacattgagctcgggagggaaatgaagaatccagcagacaaacgcgcccggatgtctcagcagatgatcaagaacgagaataccaacctgagaattaaggctttactgactgaatttcttaatcccgagttcggaatcgagaacgttaggccttacagcccatcacagcaggatttgctccgaatatatgaagagggcgtgctgaatagtatcctagaactgccggaggacattggtatcattctcgggaaatttaaccagacggatacactgaagcgccccacccggtccgaaatccttagatacaaattgtggctggagcaaaagtacaggagcccttatactggcgagatgataccattatctaaactcttcacccccgcgtacgaaattgagcatatcatccctcagtcacgttattttgacgatagtctgagcaataaggtcatttgcgaatccgagataaacaagctgaaagaccgctctctgggatacgagttcatcaagaatcaccatggcgaaaaagtggagttggcatttgataagccagtagaagttctctcggtggaggcctatgaaaaactggtccacgagagctactcccacaaccggtcaaagatgaagaaactactgatggaggacattcccgatcagttcatcgaaagacagctcaacgacagtaggtatatttctaaggtggtcaaaagcctgctttccaatatcgtgcgagaggaaaacgagcaagaagctatatcaaagaatgttatcccgtgtacagggggaattaccgatcggttgaaaaaggactggggtatcaacgacgtgtggaataagattgtactgcctcgctttatcagattaaacgagctcactgagagcacaaggttcacgtctataaataccaacaatactatgattccatccatgcccctggaacttcagaaaggctttaacaagaaacggatcgatcatcgacaccatgccatggacgcaatcattatcgcctgcgctaatagaaacatagtcaattacctgaacaatgtgagtgccagcaagaacacaaaaattacccgcagggatctacagacactcctgtgtcacaaggacaagactgataacaatgggaactacaaatgggttatcgacaagccttgggagaccttcacgcaagataccttgacagcactgcagaaaattactgtgtcttttaagcagaatttacgtgtcatcaacaaaaccacaaatcattatcagcactacgaaaacggaaagaaaatagtgtccaatcaatcaaagggcgacagttgggcgattagaaagagcatgcacaaagagactgtacatggtgaagtgaacctcagaatgatcaagaccgtttcgctgaatgaggctcttaaaaagccccaggccatcgtcgagatggatctgaaaaagaagattttggcaatgctcgaactggggtatgacacgaaaaggatcaagaactacttcgaggaaaataaagatacatggcagtga

SEQ ID NO: 2903 - RNA, 3741 nt, synthetic construct
  misc_feature 1..3741: note = Cas9 variant
  source 1..3741: mol_type = other RNA
atgagactggtgtacctcgcccttgctcacatgatcaagttcaggggccattttctgtatgagggggacttgaaagcagaaaacaccgatgtccaggccttattcaaggactttgttgaggaatacgataaaacaattgaggaaagccacctgtccgagataactgtggacgcgctatctatcctcacggagaaggtatcaaaaagtagccggctggaaaatcttattgctcattatcccaccgagaagaagaacacactgttcggaaatttgatcgccctctccctgggtctgcaagcaaactttaaaactaatttccagctctctgaagatgccaagttacagttttcgaaagacacctacgaggaggatctggaaggccttttgggggaggtgggagacgaatatgctgatctgttcgtctcagcaaagaacctatacgacgccattctcctgagcggcatccttacagtggatgacaatagtaccaaagctcctctgtccgcctctatggttaagcgctataaggagcacaaagaagagttggcggcatttaagcgattcataaaagagaagctcccgaaaaagtacgaagagatctttaaagatgacactaagaacggttacgccgggtatgtgggagctgacaagaaactgcgtaagagaagcggcaaattagccacagaagaggaattttacaagtatgtcaaaggcattctgaataaggtggagggggcagattactttctcgacaagatcgatagggaggacttccttcggaaacagcgcaccttcgataacggatccattccacatcaaatccatctgcaggaaatgcacgctatattgagaaggcagggtgagcactatccctttctaaaggaaaatcaggacaaaattgagaagatcctgacgttccggattccttactatgtaggcccactcgcccgcaaagggtcacgatttgcgtgggccgaatacaaggcagatgagaagatcactccctggaacttcgacgatatcctggacaaagagaagagtgctgaaaaatttattaccagaatgacacttaatgatctgtacttgcctgaggaaaaggttctcccaaaacacagccccctgtatgagactttcaccgtgtacaacgagttaacaaaggtcaagtatgtgaatgaacaaggagaggccaaatttttcgacaccaacatgaagcaggaaatatttgaccatgtgttcaaagagaacaggaaggtcacgaaagataagctgctaaattacctcaacaaagaatttgaggagttccggatcgttaatctgactggccttgacaaggaaaacaaggcttttaatgcctctttgggtacatatcacgatctgcgtaaaattctcgacaagtccttcctggatgacaaagtgaacgagaagatcatagaagatattatccagacccttactctgttcgaggaccgcgaaatgatcagacagaggttgcaaaaatactcagatatttttacaacccagcagctcaaggagctggagcggcgacactatacggggtggggacgcttaagctacaagctgatcaatggcattagaaacaaagaaaataagaaaaccatactagactacctcatcgatgacggctatgcaaacaggaatttcatgcaactgattaacgatgacgcccttagttttaaggaggaaatcgctcgggcgcagatcattggggacgtagatgacatagcaaatgtggtccatgatttgcctggatctccagccatcaaaaagggtattctgcagtccgtgaagatcgttgacgagctcgtgaaagtcatgggccacaacccgacaaatattatcatagaaatggctcgcgagaaccagactaccgataaggggagaaggaacagccaacagcgtctgaaattactgcaggactcgcttaagaatttggataaccccgtgaatatcaaaaacgtagagaatcagcaactccagaacgaccggctgttcctatactatattcagaatggaaaggatatgtacacaggcgaaactctggacatcaacaatctctctcagtatgatattgaccatatcatacctcaagcctttattaaggataactccctggacaatcgagttcttaccagatcagacaaaaacaggggtaagagtgatgacgtgccaagcatcgaggtcgtgcacgaaatgaaatccttctggtctaagttgctgagcgtcaaattaattacacagcgcaagtttgataatctcaccaaagcagagcggggcgggctgactgagaacgacaaggccggattcatcaagagacagcttgtggaaacgaggcagataacaaaacatgttgctcaagtgctggatgcccgctttaatgcaaagcacgacgagaacaaaaaggtaatccgagatgtcaaaattatcaccttgaagtcaaacctcgtgagtcagttccggaaggactttaaattctacaaggttcgtgaaattaatgattatcaccatgcgcacgacgcttacctgaacgccgtgatcggcactgcactactgaaaaagtaccccaaactcgcctccgagtttgtctatggggagttcaagaagtacgatgtgagaaaattcatagctaagagcgacaaagaaattggaaaggccaccgcaaaatatttcttctactctaatctgatgaactttttcaagaaggaggtaaaatttgctgacggtacagtggttgaaaggcctgatatcgagacctcagaagacggcgagatcgcctggaataagcagactgatttcaaaattgtccgcaaggtgcttagttatccacaagtgaacatcgtcaaaaagacagaagttcagacgcatgggttggaccggggaaagcccagaggcctgtttaatgcgaacccgagccctaaacccaagccagattcctctgagaatttagtgggtattaaaaggaacctcgaccctaagaaatacgggggctatgccggaatatcgaatagctacgctgtgctggtaaaggcaatcattgagaaaggcgtcaagaagaaagaaaccatggtgcttgagttccaggggatctccattctggatcgaatcacttttgaaaaggacaaacgcgccttcctactcggaaagggttacaaagatataaagaagatcattgagctgcccaaatattcattgtttgaactgaaggacggcagtcggagaatgttagcttctatcctcagcacaaacaataaacgtggggagattcacaagggaaacgagctgttcgttccacagaaattcaccacacttctgtaccacgccaagaggatcaataaccccataaacaaggatcatattgaatatgtgaaaaagcaccgcgacgattttaaagagttgctcaattacgtcctggagttcaacgaaaagtatgtgggcgcaactaaaaatggtgagcggctaaaggaagcggttgccgactttgactccaagtcaaacgaggaaatctgcaccagcttcctgggggctgtaaattctaaaaacgccggcctttttgagctcacgtccctgggaagtgcaagcgatttcgaatttttgggcgtgaagatccctagatacagggactataccccatcttccctgttaaaagattcaattctcatacatcaaagtatcacagggctgtacgagactcgaattgaccttagcaagctgggagaggattga

SEQ ID NO: 2904 - RNA, 3747 nt, synthetic construct
  misc_feature 1..3747: note = Cas9 variant
  source 1..3747: mol_type = other RNA
atgaagaaaatcctgggcctcgaccttgggagcgcctccattggatgggctgtgataaccgagaacgtcgaaaatggtatcacaaagtgcgatattctgggcatggggtctagaatcattccctacgagggaactgaaggcaaagacttcacgaagggtaccggggagtcaaggaacagtttgcggacaaaagcaaagactgcccgcaagggatatgatcgataccagttacgtagaaaatatctggttgacaccctaatcaagaatcaaatgtaccctgatgaagcgacaaggaacctcccaaaaatgaagctgtgggagcttcgggacaaagctgtgcacagcccggtatccctgatggagttgggccgcctcctgctgtggctcaatcagaagagaggctataagtcttcgaggtcagatgccaacttagggaaaaaggacaccgaatacgtggcaactgtcaaaagccggcatgagaagatgaaagaactggatgtgacaataggacagtatttttaccgcgagcttagtgccaatgagttctttaaggttaaagaaaacatcttcccccgagaggcttacattgaagagtttgacgcaatctgtaagacccagcaaattgcccaccctatgatcttgagatccgaactgatagataagattaggaatgaggtgatctattaccagcggccactaaaatctcagaagggtctcgtcagcgtgtgcgagttcgaaggcttttggcgtattgggaaagacggaaaggagtatttcgtaggccccaaagttgctcctaagtcctcaccactgtttcagcttgccaagatgtgggaaaacatcaataacatcaaaattggtagtcgcacgggggaggatctgaagttgactaccgaacaaaaatgggcgatattccagcatctcgacaataacgagaagctgacacccactgacttactgaaaatcctcaatcttaagaaggagaactgttacgtgaacaaacagatgggaaagggcctgaatggcaacattaccaaacacgcaatcttgcagtgcctagggggaagcgataagtatgaaaatctgctcaaactggagcttaagatggtcgacggtgataaggaaggctacctgtatgacagaaaaacaggggaggtgttgaactctaagatgataaaatttattgatcctatggtggaacaagagccattctaccagctctggcatatcatctactccattcacgaccaggaggaatgttcaagggtcctgcaagccaagtttgatatcgagcagccgattgctgacaaattagccgcaatagatttcagcaagcacgctttcggaagtaaatctgccaaggttatccggaagattctgccctatctaatggacggcgatggttactccgaagcgatgagctatgccgggtacgaccattctaattcgcagaccaaagaggagaacctccagcgaaagctgcttgacttgctgaaacctatcccaaagaactccctccgccaacccatcgtggaaaagattctgaatcagatggtaaatgtggtcaacgcaataatcgagaagtatggcaatcctgatgaaattagagtggagcttgctagggaactgaagcagtcaaaagaggagcggaacgacgccgataaggctatgagtaaacgccagagagaaaatgacgccatcacgaagaggttggaggaatttggactccgtgcaactcggaacaatattatcaaatggcgactgtacgaggaaatagataaccaagagaagaagttaaacgccatgtgcgtttattgtggccagccaatcagcctgacagaggctctaagagggaatgacgtggatattgaacacatcattcccaaatccaaactcttcgacgattctcagagcaacaaaaccctggcgcataggcactgcaataagaacaaaaatgaccttactgcatacgattttatgaagggaaagccggaggccgtcttcaacgaatacgtggagcgcgtaaatttgctgtatgacaaccacatcatacggaaagctaagagagataaactcctgatgacagaatcaaagattcctgacaattttatcgacaggcagttacgcgagagtcaatacattgccaaaaaggcacgagagatcctgcagaccatatgtcatgatgtttggtccacgagcggtaccgtgacagccgaacttcggcacttgtggggctgggacgatgtcactatgaacctccagatggctaaatatcgtgagctggggctaacccatcaggtggaatgggagtctgagcacggaaagaataagcatgaaaaagaggtcatcacagactggactaagagagatgaccacaggcaccatgccgtggatgcactgaccattgcgtgcacaaaacaaggcttcatccagcgctttaacaccctctcagctgccaagactcgggaagacatgatgttcgatattgagcagagaagtcacgaatttaaagagaagaggagcctgcttgagaagtacatcatatccgaacaacccttgaaagttgacgaggtggaaaaggcagtatctaatattctgatctcgttcaaaagcggtaagaaagtcgccgtgtgggggacgcgaaagatcggcaagcgcggatccaaaaaggttattcagaaaaagatcattgtgccacggggctcattaagtgaggaatctgtctatgggaaaataaagaagcaggaggagaaagattacaagtatctctttgaaaaccctcagctgatcttcaatcccacaattaaagctaaggtggaggaaagacttctgatgtttgacggagatgtgaaaaaggccatcaccagcttgaagaaaattccaatctacctcgacaacaacaagactgtagttctggagaaagcaatatgtctaaaggacgagttcgtcatcaaatactccgtggatattaatttcaacaaggtggacaaagtcgttgatcccaagatcaaggaaattctgcaaaataggctcaaaaagtttggtggcaaagagaaggaggctttcaaagacgtgcagctggaagataagatgatcataaagtggtatgaagacgaggggcttgagcgtcctattaaatcagtgcgctgctttaccggattgagcgccgtagtcccagtgaagaaagatgaaaacggcaatgacatcggtttcgttaagccggggaacaatcatcacatcgcgatttacacagataccgaggaaaacaaacagcagcacgtgtgcactttttggcatgccgtcgagcggaagaagtatgacatacccgtgatcattaaaaatacaaacgaagtttgggataagatccaatctcagcctgacggcacgtacccagactccttcctggagatgttaccccctccaaatctcaacctgcttgtgaatatgcagcagaacgagatgtttattctgggaaccactacagaagatatcaaactagctatagacaagagagattataaaatcattggcgacaagctctacaggctgcaaaagatgagtatcaaacccagctctgggcagattgatatcgtattccgacaccatttggagacccagctgatagacgatgaaaattccaagaaatcaaagcggttttataacgtccaaagtttaggagcactcttcgccctgaacccgtttaaagtgcgcattgacaatcttggcaacctggtgaaggagaaatga

SEQ ID NO: 2905 - RNA, 3762 nt, synthetic construct
  misc_feature 1..3762: note = Cas9 variant
  source 1..3762: mol_type = other RNA
atgaaggccagaggcaacttcctgcaccaggacacccccgggctcacagctgcaaatgccaacatgggagatgcggtggagaaactttgcgtcgctctggaagactggtgtactttgaggaatttagagtgcaacatccggaagaatcagaaaaacattcaaaatctgctagaaggtaagacggttgaggtgagcgccgaaaacgcactcaaagagtcctttgattcttcacgcgccagtcgaaaggacaaggctaccatactgagcacatggatcgcaattcagcctggcgagtaccttgatgccaaacaggctaaggacgcctccaaagaaatcgcgaatgtactgttcgggttgcaaggaaacatgaagaaaatttttatcgagttcgaagaggatcagaagatacgtctcgacaatgatgaacaggtggaagcattttattctctgtgtccagacgatggcgtcgccctgttcgagtcgtttcagtcaatctacagcgcttatattctcatgggtatcttaaagaacgccaatgggggaagtatttcctcttgcaaagtggcagcttacgaccaatataaggaagatctgaaacttttgaaggacctggttagagagttcgccagcgaaaaatacgacgagtttttcaggggcgatatctttgactcctcaaagggcttccgggcgcgcaactataatccggccactgcaaaagggtacaccaagtacaacagtgtgagaggagctagctatgatgactttaagaaagaggtcgaaaagatattcaaaggtacagtggccgaggaagatattaggtacgtagacatgatgcagcggttcgctgagggcacctttctacgccgactcaagacttctgataacgggtccatcccctatcagctgcatcttgaagagatggacgccattgttgagaatcagaaacaattctacccttttctggaatcagagaaggaaaagttggagagcctcgtgacattcagaatcagttattacgtcggaccactgacccagaaaaacgcaaggttagataatcacaacaatgcccggtttgcttggtctcagcgtaaggaaggcaaagagcatgcgcgcgtgtatccctggaactgggaggaagtgatcgacagaaagcaatccgcagccaaattcatggagaggctgacgggtacttgtacctacattctcgatgaacctgtccttccacggtgcagcctgttgtacgaggagtattgtctactgaatgaactcaacgggtcgaagtggcgagacatgggaggcgactggcaccgctttgattacgagacaagaatggaaataatcgagaatctgttcaagaaaaagaaaggctctgttaagtatgctgccgtggaagactggcttaaatgcgagaagcataagtcctgtgcagaggtaaaagggggacagggtgaaactggctttgagtcaaagctgagtagctacgtgttctttaaagaagtcttgcacgtggatgagattgacgaagccgatatccccatgatagaggagctcatttggtggaacaccctgttcgaagacaggtccatcttaaaggagtctatcgaagataaatatggggaccggctgacagatgaccagattaaggctatctgcaaaaagcgctttaccggatggggcagactaagcaaggagctcctgtgtggtattaaaacgcacactgataatgggccttactcaataatggacgttcttagggaaggcaacccaaataacaatgcccgtagtgagacaatggtgttcatggagatcttgcgggatgacaagttcggatttgacaaactgattgaagaggaaaacatgcgaagagtctccgaggtggataacttcgacgtaaatgatctcccgggcagccccgcagttaggcgcaccgtgaaccaggcgaagcggatcgtcgacgagatcgtggggattgctggatgcgaacctcaaaatatatttatcgaggtcactagagatgaagacggtaggaacaaaggccgccgaacaaagcggcgttatgataatattaagaacgccatcgcagccctgaaaaaggagcagaaagaatacttcaataaggacgtgtctgattcacttaacaaaaccaatccaagtgacctggataacgagagattggctctctactttatgcagaatgggaagtgcatgtattgtggaaaggacctggatattaaacagttagacaagtaccaagttgaccatatcctgccccagagctatgtgaaagatgactccttcgagaacaaggccctagtacacatggaagataatcagaggaaatctgcatcgatgctcctggacgatagcataatccgcaagatgaagccttactgggaggcccttcgggctgcgggcttgattggtgagaaaaagtttaaaaacctgacgagagtcagggtgtccgacaaggagctcgggggcttcatcgcccgacagatggttgaaacctcacaaagtatgaaactgacatctttagtgctggagaagacttatccaaataccaacgtccgccccgtgaaagctggatttagctccgatcttcggaagagattggacctcattaagtgcagggagatcaacgattaccatcacgcacacgacgcctatctggcttgtgaaataggccagttcattacaatgcgtcataataaactatacgagaacccgatctcatacagccacgccgtaaaggattttattgcaaaacgcgcgaagtatgccaatgaccatgggactcctatgtctacctacggaatgcccggttccagtagcttcgtgatctcttcctttctgacatcaggcttcgacgaagagaccggggaaatattcaaagatgcttggagtgccgaggttgcagctgtccggatcagagagagcctcaacaggaaggactgctatatttcgcgaatgccagaagagacttccggagccttttggaaggaaacgctgatctctcctcgggatcccagccttggcaaaaatttgtcactgccaattaagaaaggtttagacccccgcaagtacgggggctataacgagcagaaattcgcatactttttcgtgtatgaggccgtgaagatcaagaaaaagggagaagtcaaagagtacgtttttgctgcggtgcctgtgcaggtagccgcaatagtcgctagagatccaaatgccctcacaggcttcgccaagaaagacgctgaagcaaggaagattaagtttctgcggatcatccgagagaaagtgtacaagtatcaacttattgaagttaacggggagagactgtacatcaccggattgaaaagtgtgcgcaatgccaggcagattgcgctctcccaggatatgactaccgtcttcctgaaggctataaacgacaaagatgtggccgaggacgaactaaagtctctgtttgaggaaatcgttcaacgttatcggctctgtgcaaatagactgggcaaccagcttaagattttcagcttgtccgattcatttaatagcgccaacagtgagtctaaaaagagggctctggtgtccttagtagcaatcattgacgccaaaacaaataagatcgatctcagcggtatagggtcgggaaaagcggtcggcaacatgcgcctgtcattctctaaggaaatgagtaactccaaaaatcacttcgcttttatcgaccagagcgtgaccggtatgttcgagcgaaagacttacctttga

SEQ ID NO: 2906 - RNA, 3777 nt, synthetic construct
  misc_feature 1..3777: note = Cas9 variant
  source 1..3777: mol_type = other RNA
atgaccgaggaaaaccccgacatcagaaaggtgttcctggccattcaccatatactcaaaaataggggccactttcttctgcaggggcaatcattcaaggagggaaacttgaataacttaatcaaagaactgctaaatctcgatattctgcatatctccattgagatcacagaagagaacataaataagatcactgagattgctcttgagaaaaagacgctgaccgacaaggtcaacgatttgaaaaagatctaccctaaagagaagcagctcctggaagcatttcggctgattttcggtggcaaaacatctctcgacaagttatttgccatcgatgagtataaggagctggacgcgtcagttaaaagtgtgagcttcaaggagaaaatatacgaagaagtacgccacgattatgaacaggtgctttccaattacattgaattgctggacctagctaagctcgtctatgattctatcattctgtcggacatcaaaaaggaggggaaaactctttcagagagcaaggtggaactgtaccataagcaccgagaggatttgaccaaactcaagacactggttaaaaacgacagtaagttatccgaagataaaaaggtggagctgtattctgccatctttaaggaagacaaagacaagggaaccaattacgtcaactacattcgtaaaagcgaggagggcaagggttgcaattatgaagatttcaaaaagtttctcgtgaaggagcttgcaaaactggaagagtcctcagccaaggaagagatattgagagacctagagctggaactcttcctgccacttcagaggactaaagataacagtgtagttccgtaccaaatccacaaggaggaactggtgaaaattttggacaatgctgcaaagtatcataagtttctcaacgagaaagatgacagcgggtactctatcatagagaaggtcattcagctgttagaatttcggatcccctattacgtgggacctctgaactccagcaaaaaggccaaagtggatggctttgcttggagcgtccgcaataagggctatgagaacacaccagttaccccctggaattacgaaaaagtgatcgacgagagtgcctctgcggaaaagttcattacgaacctaactaataagtgtacctacctcaaaggggaggatgtactgcctaagtccagccttttgtattcggagttcgcactgctcaacgaactgaatgcccttaaatacgacggaaacagaatctctctggaggctaggaatgtgattatagaaaagttgtttaaagagcagggtaagaaggtcacaaaaacttccatcaagaacctcctgaaagccgaaggctatattgatgggaagggagagatcaccggcatcgacattacagtgaaaaatgacttaaagtcataccgggatttcaagaaaatactgggtgacaagtttaacaccgagcacgttgaaaatatcattctatggatcacgctctatggggagagtcgcaaactgattaaggcaaaaatcgaagctgtgtacggagatatatatagcaaggaggaaatcgccaagatgtcccgacttgtctacaaagactggggcagattctctaggaagttgctgactgagctcgtgagcaaaaagctgtacaacgaggaaacaggcgagtgcttaaatattatcggggcgatgcggcagaacaacattctgtttatggaacttttggccgatcgtttcgactattcacaacagatcatagattacaataaagagctccagaaggaggtaaccgaaattactccagagatcctggacgatctatatgttagtccctccgtgaaacgcagcatttggcagacagtcagaatcgtggaggaactgaagaagataatcggatgtgctcctgcaaaaatttttgtcgaaaccacgaggtctaaccaagacaagaaaaagccaaccgattcacggaaaaagcagctcgagctgttctacaaggccgtgaaaaaggacgttaaagatcttgagaaggaaatcggtagtttgaattttgacaaactgaacgagcgattaagctccgtggaaccgtctaagctcaaggctaaaaagctgtatctttactatacacagctgggccgctgcatgtactcgggggagactattgacatcacccaattgaatacaactgcctacgatatagaccatatttatccccagagcaaagtaaaggatgactccttcaccaacacagtcctcgtgaaaagagaatacaatgcagccaagaccgataggtatcctctgggatcagacatccagactccaagtaaccggcgcttttggaagttcctaaaagagaagggcctgatcacggatgagaaatacaatagactcgttaggacagaagagttttctgacgaggaactgaccggtttcattgctcgtcagcttgtggaaactagccaatccgtcaaggcggtggcagggatcttgggcgagctgaaccccaaaacctcaatttgttatagcaaggccgagaatgtatcttccttccggcagaactttggaaagataaaagaaggcaatcgaaagagtgataacacagagcagttaatcaaagtgagagaaattaatgactaccaccacgctaaggatgcctatctcaacgttgtcgtggggaacgtgtacgacaccaaattcactaggaatgtctttaacttcatcaaggataaaaaggacggacgcaagtacagcctgaataacgttttctatgagaatgtgtctaactccaataacgtggcatgggagcttaataaaacagtacatcaggtcgaaaaggtgatgaacaataacaatattctggttacgcggagaacctcagagcaaaaaggtggcctattcgacgccactgtgtacaaggctaaagtcgccgcaaaggcgaaggaaggggtgtattaccctctcaaaacaagtgatccagttgtgaacgacgtaaccaagtatggaggctttacaaaagtcaagatcgcttactatagcatattcgagtacactctggtgaataaaaagggtgaagagaagatcaccaggattatccccattccgatctacgtgtcgcagaacataaaagatgactccacgttgctggagtttgggaagacccagattaacatcaaatctggcgaagaggtcaaggatttcaaattaaagtatcgcaagctctgcatcggagacctggttaaaattaataactttttcaattttataggcgggaagacaaacgatagcttcgtgtacgacggagccgtacaggtgactcttgataccgaatcagagcgatatatcaaaacactgagtaagtaccaaaattggaaaaaggaaaacaaagacggtgagttgtgggagtccattactaaggaaaagaataccgagctctataacctgctagtcgagaaaatgaactctggcatcttcattaagaaaaagcctaataaatttaatgaactgaacagcgaagagatccggaataacttctcctcaataagccttgaggaacaggcaaaggtgctcctggaggttttgaatctgttaacgaacaagaaaagtatctttgatctcaagtctattaatatcacagccgctcgtgggaaaatttccttcaacctgagcaacctttcgcagttttcaatcatagaacagtctgtggccggattctacgagaaggagattaccatcatcggcgacaaagaaaatgacatggagaacaataactgttga

SEQ ID NO: 2907 - RNA, 3780 nt, synthetic construct
  misc_feature 1..3780: note = Cas9 variant
  source 1..3780: mol_type = other RNA
atgaagtacatcctgggcctcgaccttggggtggccagcattggatgggctgtcaccgagataaacgaaaaaggtgagcccgttggcctgatcgatgcaaattccgtgattttcaagcctttggacaacgataaagggaagttatataatgtagaaagaagggacaaacggggatctcgccgaatcctgcgtagaaagaagcacagggtggagcggacaaaaatgctactcgtcaactcaagttttctgactaatgaagagattgataacctttacgtgggcaagctggacaatatctatgaggttcgcttgaaaggtctcaaggaacagctgagcaaaaacgagatagccagactgatgatctactattgcaagaatagggggttcaagtccaaccggaaaacggaagatctcgagattttaaagtctctgggagagaaaatctcggaaaaggactcagatgagaaaaagctgaaaccaattatcgcgaagaataccgaattgatagagagcaagggcctgacaccgattgaagtgatctacatgattcgcgagaacgacaatagtatcctaggctttaaaaacaaggaggggaattataaattcggatttaagcgaaaccaagtcatcgatgaagtgagaaaaattctcggtactcagcagatactgtccaaggagatcgtagacgaatacattgatatcctttctagccagagggacttctccgacggccccgggggagattcaaagtacaaaatagactataccaagctggctggcaaatgtaagtacacaggtgaggttcgggccgtgaaaagtgcacctagctatgaaatttttaccatgttgcaaaagctcaacgatatccgttacgtcaagttcacttctgaggacaaaatcgagaagaaaaagctgtccaaagaagtgattcataagttatatgatctggtggtcgagaagaataaaacactcacctacgaccttatcgaaaagtcaattgatgaggaaaacataaaactgttgaatatcccaaagctaagcaaaagtaagtatgttgagctgcgcaaatcttactttaaggagagaaacgacaatgaaaacctcacggaggaagagattaatgccttcaacgagaagctgaataacgaaaggatgaaacaggagcttatccggaataacctgaaggcttacaaagaattgaagtccaaatttaagaagaataacatcgatgagaatcgaattaaagaactcgggggaatatatttcctggacttagtggcagagctgctaacttacagcaagaccgatgagaaactcgaatattttgtagagaacgtggaacgctactcgctgttcaaggagcagagagacatcgtcgaaattatcaaaacattccccaactatactaagaatggcaacctttctttgtccctggtgagggagctcaataagctgcttatggagggccacgactacgaatcaagtctgagctccttgaactattacattgataccgacgttgattgggagaaatttcctacaatctctgaaatagaggacagcctctcaaccaagatcacgaatccaaacgtgaaacatattctggtcatcttacggaagctgtacaatactctactcttcaaatatgggcgccccgaaaaggtgcacctggagcttagtagagatttttccaacgacttcagcacaaggaataagattcagaaagagcaattggaaaacaaggtacgtcgggaggttgccgcttttgaaatgtacggagccaataaagatatcgtggcgggtaaggaccgactgtctaacgatgacttcgtcagaataaaactctgggaggagcagaataaggtgtgcatgtattcaggcaggaccattgaaaaataccagctgacaagtgcagaggtccagatcgatcatattttaccttatagcaagtcctttgacaactcttactcgaataaggtgctggttttcagcaacgaaaaccaagataaaaaggagcgcactccatatcagtggcttaaagggaccgaaaagtggaatgagtttaaacagcgggtgagattgaacctcaatatctccaacaagaagaaagagaatctgctattcgaagacgaggtagtcaacaatgaatttctggagagggaactccacgccacgtcatacagttctcgcctggctcttaacatattccaacgattgatcccggtgagcgacgaggataagtacgacgagcacggaaatgaaaaagttaagtatctgtacaaccggaatgtgattgcctttcagggcaaaatgacctccatgttacgtaacctctattcactgaataagtacacacatagcttcgagtctgatactcttgacatcgataacaaggcattcattctgaaagaatttgagatcaataaggacaacttgaaaatgaccgcttataacgtcaatacaggtctcgaaataacttccgagaccaaggtggagaaaaacaagagtggggagttcaagacaattaaagatgaactgctaaagaaagaactggacaagaaagagaatctcatcgagatcagcgattactttaaggacaaggtactgttcgatcttaaaattgtggactttgaagagatcgataccgttgaacccgagattatatctatcttgtataagatgattactgccctgaaagaagaggtctactccaagaacagagagaatcacttacatcactcactcgacgcgttcctgcttacgatcatgaacaggagtatgcagatgaaactgattaagtacaatcagctaatcagcgtgctcaaaaacaaggaaatagagatctttaatgaagagaagggcgaatatattgactcgaaagagttcgccgaggaactgcaaaagcagaaaatcattgatatcgacggaaacgagcgcggcataaagtttaatgtgaacgggaaaacacaccggttgaatctggtcaagccttacgaaaacttcttagatgacattaagaataaaatctttgataagagagagaacaataaactcccatatcatgttgtgaagtccaaagtgtctggagcactgcacgctgaaaccatccttggtgagagcaagggcgagattactaagaggatatcagtattcgacatcaactacaaaaacctggggaagatttttgataaagacggaagtcagaaggaaatctatgagaccttggtcaaatggctcgaagccaagtccaaggattaccccaaactgaagaatggcaacattatcaaaaaggtgaaaatagttgacggtaataaggataaactaatcaagctggggaacaagcgatatgtggagatgggccgcacaaccgtcaaaattcttgtgctcaagaaagaggctgaagagggactgaagttcgcctctatcggccggtacaaatacaatttgcttaagagcgaaaaggacgttaacatttccatctggaaagacgcaatacatttctgtaaggtgagatataataaattaaaggagaacgggtacaggctcattcacgaactgatccctggagagactatcgagcttgaactgaataaaggtaacatttcaaagtgcttggtagtcggctttagcgggggaaagatcgagataagttctgtgattggcgatgccctcgacctgatcaatgataaaatttccacacgtatcaaggaacgctattacataacggtgagcaccattaaatcgatcaagaaaatcaacaagaatattctaggtgactga

SEQ ID NO: 2908 - RNA, 3792 nt, synthetic construct
  misc_feature 1..3792: note = Cas9 variant
  source 1..3792: mol_type = other RNA
atgcacaagaacaatcccgacatcagagagctgttcctcgccattcatcacatacttaaatacaggggccattttctgttcgctgggcagcaatttaagggaagcgaaatcaaagataacattcgggagttgttacagtataattccctgaacatcaagattgacatcaccgatgaactaataaataacatcgcagagattctcctgaaaaagaaaaattctacagacaaaatcattgagttcaagaaactttttgccgatgagaagcagctgatcgaggcgttgcgcctcgctctgggtaacaaaactcagctggccaaactcttcgacatagaagcatacaaggagttagatatttcaatcaaaacgattagttttaaggagaaaatctatgaggacgtgcgaagcaattacgaggaaatcctgggcgagtatattatagtccttgataccgccaagttgatctacgacgctattatcctgtccgaaataaaaattaagaacatgacaatctctgagtcgaaagttatctcatatgaaaagcacgggaaggatctaaaacaactcaagcagctgattaaagaggacagcaaacttagtaaaaaggagaagcgtcagctgttcgaaaatatctttgtgaaagaggatgaaaaggaggcaaactacgtaaattacattggaaagaacaatgtgggctcctctaagagctcctgctcatatgaagacttcaaaaagagtttgataaaggagctcaaatactgtgaggaaagcaagctgaaacaggacatcttagccgagctggaactcgagacttttcttcctagacaaaggaccaaggataactctgtcattccatatcagatccataaagaagaactggagaagatcttgaacaatgctgtgcagtaccacccgttcctaaacaatacagacgaatatggtatttccataaaggagaaaatcattcagctgctcgaatttcggatcccctactatgttgggtcactgaacaccagccacaaggtgggaaatggcggcttcagttggtctgtccgcaacaaagggtacgagagaactgccgtgacaccttggaatttcaacaaggtaattaataaagaggaatccgcgaagaactttatcgagaatcttaccaaccaatgcacgtacctgttgtatgaagatgttctcccaaaacatagcctgttatactcggagttcactctgctaaatgaactcaactctataaattatggaggtaagaggctgaccgtggagcaccggaaccttatcattgagcgctttttcaagcagtccgcacccaaagccacaggcaaggaattgaaaaagtttctgatgtcagagggggtcatcgacggaaaagatgaactcagtggcttcgacattagcatcaagaacgatctgaagtcctaccgagactttaaaaagatacttggtgagaaattcgattctgaaaaggtggagaaaatgattagatggatcactctgtttggggagagcaagcagttgctcgtggacaagattaccaaagaatatggagatatctactcaagtgaggaaataaagaaaatctccggcctgacatataaggactggggcaggttaagcgagaaactgctaaccgaaattgtctcttcacaactctacgacgagagtacgggggagtgtttcaatatcattaacgctatgcggaataacactctgctttttatcgaattgctgggaacaaattacgattatttcgagaagataaacacctacaatggtaagctccgtaaagaaattactgagatcacacctcatatcctggacgatttatatgttagcccagccgtgaagcgctccatttggcaggtagtgagaatcgtcgaggaactgaaaaaggtgattggctctgagcccaaaaggatatttgttgaaaccacgcggtcgaacaaggagaaaaagggggacgatggacgaaaggacagccgcaaaaaggcacttttggaactctacaaaaagatcaaaacctccgatattgctgagctggagaaggccctaggccacacagtggacttcgataagaaaaagcaggacctgactgatatcgacaataacaaactcaaggcgagaaaactgtatctttactatacccagttgggtaggtgcctgtacacagggaaggccattgatttaaataacctcttcggctcaaatagtgaatacgacatcgaccacatatatcctcaatctaagactaaagatggaagctggaacaatctggtccttgtgaacaagaccgagaactccaaaaagtcaaatggcctgatcagcgaatctattcagcggaaaaacaagcatttttggcgcttcttgaaggctaaaaatctcatctccgaggaaaagtacaaaagactgacaaggaccgaggactttactgatggggagctaagtggattcattgcacgtcagctgatcgaaacgagccagtctgtaaaggttgtgtccaaaatactccaaaacctgaatccaacaaccgagctttgtttttcaaaggccgaaaacgtcagtgacttccggcaggagtttggtaagattaaagtgggcaagcgaaagaatttgactgaagaggagcagaagaaagctaaggaagggcagctgatcaaagtcagagatttaaacgacctccaccatgccaaggatgcatatctgaatatcgtggttggaaacgtgtaccacattaagttcaccaggaatccgaaaaactttatacgcaagaatttcaaaaaccgggagtatacacttaataccctgttttacagcgacaaggtagaaagaaacggcgaggtcgcctgggagaaaggtaagactgaagagatcgtgtcgtccgttatgtgcaacaatctaattaacgtgacaaggcgcacgtctgaacaaaagggggctctctatgaggcgaccatctacaaagcaaatgccgctaaggaaggcagctactatcccgtcaaaactaacaataagaacctgaaaaatgtgacacgatacggaggcttcacctcaattaagatcgcctattacagtatatttaagtatgatatccggaacaaagacaaggtaaaagagaatattaagatcattcctatcccaatatacatttcccagaacatcaaaacagatttggacctgatcaatttcgcagagaagcagattaagttaaagaagggggaaaacatcgagaatctccagctgatatataaaaagctgaacattggagcccttgtgaaaatcgatcattacccctactatattggtggcaagactgacgacaatttctacgttgatggggctgtccaagtgttgctctctagcgacatcgaacgttatctgaaagaggtggtcaagtttgttaacttccagagagaaaataaggaggccaaagtgtccaaggagcacatatcactagaagagaacattaaactgtacaacacccttgtgtgtaagatggcaacgaaaatctttacccacaagaagaataacaaatataatgatctcacacaggacaaggcgaaaaacactttcaataagctgagcttggaagaacaatgcaaagtactgttagaaatcctcaacctgcttaccaataagaagacaacttttgatctgagtttgattaacgagaaaacctctagggtcaagtgtggattcaatctcctgaaccagaaacagttttccatcattgagcagagcgtgacgggcctatacgaaaaggagataaaaatcattgaagactga

SEQ ID NO: 2909 - RNA, 3795 nt, synthetic construct
  misc_feature 1..3795: note = Cas9 variant
  source 1..3795: mol_type = other RNA
atgaagaacgtgctgggcctcgaccttgggaccaatagcatcggatgggccctgattgaggtcgatgaaaacaatttgcccataagaatcattgctatgggttccaggatcattcctttatctacatcagacaaagaggagttccagcggggcctgagtatcactaagaaccaaagccgcacggtttcccgaacccagcgtaaagggtacgatagaaagcagctaaagaagtctgacctcaagaaaatactgaataagtataacatctttccatcggaggaacttctgaggttgccgatgctcgatctgtggaaactgcggtcagacagcgcaaatcccgatgagaacattagtgccgagcagctcggacgcatcttatacatgctgaatcaaaagagaggctataaatccgcgaggtctgaagctaacgccgacaagaaggatagcgactacgtgcaggcagtaaaaggtcggtatgatcagcttaaggaccgcaaacagacaattgggcaatacttctatgatgagttgtacaatgccaacgctaataactcctactttcgaatcaaggaagaggtgtatcctagagaggcatacatagaagagttcgacactattatctcagcccagagggaaaaacacgactttctgaccgatgaggtcgtgcatcagctacggaatgaaattatctatttccagcgtaagctcaaaagtcaaaagggactggttagcatctgcgagtttgagggcttcgaaaagacagtgtttgacaaagagaagaacaaaaacaaggtcgtgttcgtaggcccaaaagttgctcccaagacctctcctctttttcagctgtgtcgcatttgggaagtggtcaatactataacattgaagatcaaaaacccagaggggtccaagtacaaatggggagaaaagattcccgatatcaaagagaaggagatactcgccgactatctgttcaagaatgaatcacttagctttagtaaactgctcgagattcttgaactgaagaaagagaacgtgtacgtgaataagcagatcttgaaaggtatcaagggcaacgaaacctattctgcgctacactccattctgggggataatgagctcctgaacttcgacgtcagcatcatgacgtcgaatcaaactgcacttctggttgatagaaagaccggagagattttggaagagagggccggcctcgaactggacgcttctttagagaaagagcctctgtaccagctatggcatacaatatactccctcaaggatctggacgaatgcaaaaacgcccttatcaagcggttcgattttgacgacgagactgcagaaaaattgtcacgaattgatttcaataagcaggcttttggtaacaaaagtaataagagcatgcgcaagatcctgccattcctcatggaggggtatgactactcccagtctagctcactggccggatataaccacagtaattcccttaccaaaaacgaaagagagcaacagatcacactggataggttggagctcctgccgaagaacagcttacggcagcccattgtggagaaaatactgaatcagatgatcaacgtagtgaatgcgattctagacgaatacggcaagccttctgaaatccgcgtcgagctcgccagagaactgaaacaatcaaaggatgagaggaacgagaccgaccttcagaatagtaagaacaaaaagttgaatgatgaaattggcaaacgtctggaggaactcgggctgccagtgacgaagcggtatatccagaaatacaagtttatattccccagcttatccaagaacctgaaagaggcaaaggttaataaccagtgtatctattgcggagaaacttttaatcttacagaggctttgtctggtgacgcctacgatgtggaccatattgtccctaaagctctcctgttcgatgactcgcaaaccaacaaggtgctagtacaccgaaaatgtaatagcactaagacaaaccagaccgcctacgattatatcgcaacgaagggcgacgagcacctgaaactctactccgaaagactggacgattggtttgagagggggattatctcatatagtaagatgcagcgccttaaagtttctcataaggaatacttggagcggaaaaagctgggaaaagagaccgaaacagacaagaagttatgggagaatttcatagatagacagctcagggacactcaatatattagccgcaaatcccgagaaatcctgcagaagatttgcaacgatgtgaaaaccacagagggcggtgtcactgccaaacttcggaacctgtgggggtgggacgatgtgttgatgaatctccagatgccaaaatacaaggaactgggccaaaccatcacaaaggagtggacctcagagcacggaaaacgtaagcatcagaaagaagagatagacaactggactaagagagatgaccacaggcaccatgctatcgatgcgctagtcattgcatgtacgaaacagggctttatccagcgcattaatacactgaacagctctgacaccaaggatctcatgatcaaggaagtggaggaagccaaaatagagttcaatgagaagactaccctgcttgaaaaatatttgaagacacaaaaacccttttccacccaggaggttatgaaggaagctgacaagattctggtgagtttcaaagccgggaagaaagtagcaactatcacaaagttcaaagccacgggaaagaacaaggagaccggtgtcatcgtgccgcggggcgctttacacgaacagagcgtttacgggaaaattaaggtgatcgagaaagacaagcctctcaaatacctgcttgaaaattctgataagattgtcaaccccagaatcaaaaatctgatagaaattaagctatccgagaacaagaatgaccctaaaaaggccctcctggcattgaaaaagatcccaatttttctggatgaggaacagtcaatcactttagagaaagcgagttgctataacgacgctacagtgctcaagtacaagctgcaaaatcttaaagccgcacaggtagatgacatagtggatgaaaaggttaaaaagatcgtcagggagcgactgagccagttcggaaacaaagaaaaggaggcctttaaggacaccttgtggttcaatgaagagaaaaagattcccatcattacagtgcgcctctttgctcggccagatgccaacaacctgcagactatcaaaaaggacgagaatggcaacggtatagggttcgtggtcaccggcaataaccatcacattgcaatctatgaagataaagacaataagcccgttcaacattcgtgtacgttttggcacgctgtggagagaaagaaatacaacatccctgccgtgattagggactcctctgaagtatggaatgatctactgcgtaaggagcttccagagagcttcctcaacaaactgccggcggacaatttgaacctgaagttttcaatgcagcagaatgaaatgttcatattaggactcagtcaagatgagtttgtcaaagccatcgctaacaatgacaagtccctgctttctaaacacctgtatttggtgtggagcatttccgaaaacaattactggttccgccatcacctcgagaccaagaactcagatctgaagaaaacagacggcgttaaggaaagcaaacggctatataatatcagaagtctggggtctttattttccctcaaccccattaaggtgaggctgaactacttgggagagatcactaaaataggtgaatga

SEQ ID NO: 2910 - RNA, 3801 nt, synthetic construct
  misc_feature 1..3801: note = Cas9 variant
  source 1..3801: mol_type = other RNA
atggccaagtacatcctgggcctcgaccttgggaccaacagcattggatgggctctgatagaggtggatgaaaataacatccccattagaatcattgtcatgggttccaggatcatacctttgtcttcaaatgaccgggaggagttccagcgcggcttaagtatcactaaaaaccaaaatcgaacaattagccgtacgcagagaaaggggtatgataggaaacagctgaagcggaacgacctaaataaagttctcaacaagtacaatatctttccatccaagatgctgcttaacctgccgatgttggatctctggaaactgcgctctgactcggcaaattcaaacaaggatattagcgccgaacagctgggaagaatcctctatatgttaaatcagaaaaggggctacaagagtgtgcggtccgaagcgaactctgacaaaaaggataccgactatgtacaggctgtgaagggtcgctacgcccagctgaaagatcgaaatcagacaatagggcaatatttctacgaggagctttacaacgcaaacgtcaataacagctattttaagattaaagaagaggtgtaccccagagaagcctatatcgaggagttcgacactattatcaattcccagaagaccaaacacgaatttttgacagatcagttcgttcatcagctgaggaacgagatcatttactttcaacggaagctaaaatcacagaagggactcataagtatctgcgagttcgaaggctttgaaaagaccgtgttcgacaaagagaagaataaacacaagattgtctttgtgggccctaaagtagctccacgtagcgcacccctgttccagctttgtcgcgtttgggaggtgatcaacactatatctattaaggtcaagaatcctgaagggtccaaatataagtggggagagagaatcccatcaatcaaagaaaaggagattctggccgactacttgtttaaaaacgaagtgctcagcttcacaaagctgttagagatcctgggtctcaataagaacgatgtgtatgtcaataaacaaattcttaagggcataaaagggaacgagacctacgctacgctgtacaatatcttgggagaaaacgagttcctaaattttgacgttagtattatcccctctaaccatacttccatgctggtggataagaaaaccggcgaaatcctcgaggaaagggccggtctggagcttgacgtaagcctggagaagcagcctttctatcagttgtggcacacaatttactcgctcaaggatctggacgaatgcaaaaacgcgttaataaagcggtttgatttcgacgatgagactgcagaaaatctgtctcgaatcgactttaacaaacaggccttcgggaataagtccaacaaatcaatgcgcaagattctaccatttctcatggagggatatgattacagtcaaagctgttccctggctggctataatcattctaacagccttaccaaagacgagagagaacaacaggtgacattggacaggctggagctcctgccgaaaaattcacttcggcagcccatcgtcgaaaagattctgaaccaaatgatcaatttggtgaacgccatactcgatcagtacggcgagctgagtgaaatccgcgttgagttagcaagagagctgaaacagtccaaggacgaaaggaatgatgctgacctacagaacaccaaaaataagaaactcaacgatgagattgggaagcgtctggccgaacttggattgcctatcacgaagcggtatattcaaaaatacaagttcatctttccaagcctgtctaaaaatctcaaggacgcgcacgtgaacaaccagtgcatatactgtggtgagactttcaatctgtcagaagccttaagtggcgatgcatatgacgtcgatcacattgtgcccaaagctctgctttttgacgatagccagacaaacaaggtattggttcatcgaaagtgcaattccaccaaaactaaccagacagcctacgactatatctctaccaagggggatgagcaagtgagaatttacttcgagagggtcgacgactggtttaaatcgggaatcataagctattccaagatgcagcgcctcaaagtgtcacacaaggaatacctggagcggaagaaaatcggcaaggaaacggagaccgataaaaagctatgggaaaatttcattgacagacagctgagggatacacaatatatcagtcgcaaatctcgagagattctccagaaggtctgtaacaatgtgactaccacagagggtggggttactgctaaactgcggaacctttggggctgggacgatgtgttgatgaatctgcagatgcctaagtaccgtgaattaggacagaccgtaatcaaggagtggacaagcgaacatggcaaaagaaagcaccaaaaagaggaggtcgaaaactggaccaagagggacgatcaccgccatcacgccatagacgcactcgtgattgcctgcactaaacaggggttcatccagcggatcaatacgctgaactcctcagatacaaaggaccttatgctgaaggaggttgaagaggctaaagtgaagtttagcgagaaaaccactttgctcgaaaagtacctgagaacccaggagccattctctacacaagaagtcatgagggaggcggataaagtgctagtatcctttaaggcaggaaagaaagtggccaccattactaagttcaaagctatcggtaagaataaagacagtggcgttattgtcccccgaggggccctgcatgaacagagcgtgtatggaaagataaaggtgatcgagaaagataagccgctcaaatacctgtttgaaaactctgaccgcattgtcgaccctaaggttaaaaagttggtggaggtgcggttgtccgagaatgaaaacaactcaaagacagcaatcagtacgctgaaaaaggcccccattttcttaaatgaggagaaaaccgaagtactcgaaaaggctagctgttataacgatgccactgtcctgaaatacaaacttcagtcgatcaaagcatcccaggcggacgatatagtggacgagagagttaagtttctggtgaaggagaggctagctcaattcggcaataaagaaaaggaggcctttaaagatatcctctggttcaacgaagagaagcagattccaatcatttctgtccgtctgtttgcacgccctgacgccaataaccttcaggtgatcaaaaaggatgagaatggtaagagcatagggttcgttctgacaggcaacaatcaccatattgctatctatgaagacaaagataacaagttaatccaacactcatgcaccttttggcacgccgtggagcggaaaaagtacaatattcccgtagtcatcaaaaacagttccgacgtgtggtctcagctcctggataagcagcttccagaaagcctgttgaataagctccccacagacaaactgaacctaaagttctccatgcagcaaaatgagatgttcatactgggactttcacagaaagaatttgacgaggcaattaagaacaatcataagagcttcctcagtaagtatctgtacttggtgtggtctatctccaacaacgattactattttagacaccatctggagactaagaataccgaattaaagaacattagcacggctaaggagtcgaaaaggtacttccgatttaagtcagtcggcgccctcgttgggaccaatcctatcaaaatacggctgaaccaccttggagaaatcaataaggtgggtgagtattga

SEQ ID NO: 2911 - RNA, 3807 nt, synthetic construct
  misc_feature 1..3807: note = Cas9 variant
  source 1..3807: mol_type = other RNA
atgaccaagaacatcctgggcctcgaccttgggacaaatagcattggatgggccctgatagaggtggatgaaaacaatactcccatcagaattatcgctatgggttccaggattatccctttgtctacgtcagacaaagaggagttccagcggggcttaagtataaccaagaaccaaagccgcacagtctcccgaactcagcgtaaagggtacgatagaaagcagctgaaaaagtctgacctaaagaaaatcctcaataagtataacatttttccatcggaggaactgcttaaactgccgatgttggatctctggaagctgaggtcagacagcgcaaatcccaacgagaatatcagtgccgagcagctgggacggattctctacatgttaaaccaaaaacgcggctataagtccgcgagatctgaagctaatgccgataagaaagacaccgattacgttcaggcagtgaagggtaggtatgcccagctgaaagagcggaaccagacaatcgggcaatacttctatgaggaactttacaatgctaacaccaataacagctactttcgcataaaggaggaagtatatcctcgagaggcatacactgaagagttcgacacaattatcaacgcccagaaaaataagcacgactttttgaccgatgaagtggtccatcagctgagaaacgagattatctatttccagaggaaactaaagtcccaaaagggactcgtgtcaatctgcgagtttgaaggcttcgagaaaacggtttttgataaggaaaagaataaggacaaagtggtcttcgtgggcccaaaggtagctcccaagacttcacctctgtttcagctttgtcggatttgggaggttgtgaacaccataagcctgaaaatcaagaatccagaagggtctaaatacaagtggggagagaaaattcccaacttgaaggagaagcagatcctcgccgactatctgttcaaaaatgattccttatcatttacaaagctgctcgaaatacttgacctgaacaaaaatgatgtctacgtgaacaagcaaattttgaaaggtatcaagggcaatgagactttcagcaccctacacacagtgctgggggacaacgaactcctgaatttcgatgtcagtatcattccttctaaccatacctccatgcttgttgacaagaaaacgggagagatcctggaggaacgtgcgggcttggagctcgatgcaagcctggaaaaggagccattatatcagctgtggcacactatttactcgctaaaagacctcgatgaatgcaagaatgccctgataaaacgctttggtttcgacgatgagacagctgagaaactttctcatatcgactttaacaaacaggccttcgggaacaagtccaataagtcaatgagaaaaattttgccgtttctgatggaaggatacgactatagtcagagctgttccctcgcaggctacaaccactctaatagcctgaccaaggatgagagggaacaacagatcactcttgaccggctggagttgctcagtaaaaacagtctgcgacagcccatcgtggaaaagattttaaatcagatgataaacgtagtgaatgctatcctggagcaatatggcaaactatccgagattcgcgtcgaactcgccagagagctgaagcagagcaaggatgaaaggaacgacgcggatcttcaaaattctaaaaacaagaaattgaatgaggaaatcgggaagcggctggccgagctcggactgcctgtgacaaaacgctacattcagaagtataagttcatctttccatcattaagtaaaaacctgaaggacgcacacgttaataaccagtgcatatactgtggtgagaccttcaatcttacggaggctttgagcggcgatgcctttgacgtggatcatatcgtccccaaagctctcctgttcgacgattcccagaccaacaaggtgctagtacacagaaaatgcaactctacaaagactaatcagaccgcctatgactacattgggacaaagggagaagaacaggttagggtgtactcggagcgtatcgatgactggtttaaacggggcattatcagctattccaagatgcaacgactgaaagtctcacataaggaatacctcgagagaaagaagctgggtaaagagactgaaaccgacaagaaactttgggagaacttcatagataggcagttgcgcgacacacagtatattagtcggaaagcaagagaaatcctgcaaaaggtgtgtaataacgtcaccactacggaagggggcgtgacagccaaattaaggaatctctggggatgggatgacgttctgatgaaccttcagatgcctaagtacaaagagctgggccagaccgtgattaaggaatggacttctgagcacgggaagcgcaaacaccagaaggaagagatcgaaaattggaccaaacgagatgaccatcggcaccatgctatagatgcgttggtagtcgcatgcacaaagcaaggatttatccagcgtattaacaccctcaatagctccgacactaaagatctgatgcagagagagatcaaggaggccaagaaactactgggtgaaaactataatgagaaggagttcgaaaacgacaatgagttcgtgaaaaaccacaaggaaaggctctcacagctggatgactaccttcgcttgcaaaaaccagttaagtttgatacaaagtatgtggagcaggaagctgacaaagtcctggtgagcttcaaggccggcaaaaaggtagcaacgattaccaaatttaaggccactgggaagaataaagacacaggagtgatcgttccccggggcgctttacatgaggccggtctctacgggataagaaccatttactctaagggcggaatcgcagaaaaacacatcattaagaaatataaggtcggcgtgtccgcgcaggatcacatcttcacagggaaagagacttacagtgtgaagaaggacaaaaacggaaacgaaaaggtcgatgacaaaattaagatagttctggatagcatcgtggacaataaagtgaaggaggtagtccttaacaggctgaatcgaggttttaacaatgaggaagattatcgcattgacgtgaagaaagctctaaacaatttcaagaacctcgatgaggacccgctgtggtacaatgaatctaaaggcatcaagattttgtccatcaaactgaagaccgggttaaaggattcagttgtgcctctccggctgaacgagaaaaatgaggtcataacgcttgtgaagaccggaaacaatcatcacatcgccatttatgaagacaacgacggcaaactgatccagtacagttgtacattttggcatgcagttgagagaaagaaatataatattcccactgtgatcaagaacagctcggaagtatggaatcaagtcttggataagaaactcccagagtccttcctgaacaggctacctgccgacaagctgaaccttaaattttctatgcagcagaatgaaatgttcatactcggtctgttggaggaggaatttgataaggctattaaagacaacgataagagcctgttatcaaaatacctctacctggtgtggagtatcgccgagggggactattggttccgtcaccaccttgaaaccaagaatacagagctgaagaaaactaacggcgcaaaggaatccaaacgctactttcggttgtctaccaagggactcatcgatctgaatcccgtgaaagtcagactaaaccatctgggcgagattacgaagataggggagtattga

SEQ ID NO: 2912 - RNA, 3810 nt, synthetic construct
  misc_feature 1..3810: note = Cas9 variant
  source 1..3810: mol_type = other RNA
atgaacaatagcatcaagtccaaacccgaggtgaccattggcctggacctcggggtcggatctgttggttgggccatagtggataacgaaacaaatatcattcaccatcttggctcaagactgttcagtcaggctaagactgcagaggacaggcggagctttcgcggggcccgacgtttgatcagaaggcggaaatacaagttaaaacgcttcattaacctgatctggaagtataattcctactttggattcaagaacaaagaagatatactaaataactatcaagagcagcagaagctccacaatacggtactgaaccttaaactggaagcgttgaatgctaagatcgaccctaaagccctctcttggattctgcatgattacctgaagaacagaggccacttttatgaggacaatagggatttcaacgtgtacccaaccgaggaactcgcaaattattttggtgagtacgggtactataagggaatcattgactcgaaagaagataacgacgataagttagaggagggcctgacaaaatacaagttctcaaaccagcattggcttgaagagatcaaaaaggtcttgagcaatcaaactggcctgccggaaaaatttaaggaggaatatgagagtctattctcctacgtgcggaactattctgaggggcccggaagcataaattccgtttcaccttacggtatttatcacctcgacgaaaaggagggcaaagtggtccagaagtacaacaatatctgggataaaaccattgggaagtgcagtatctttccagacgaataccgcgcccccaaaaacagccctatcgctatgattttcaatgagataaacgaactgtctacaatccgatcctattcaatttaccttaccggatggtttatcaatcaggagttcaagaaggcatatctgaacaaattgctcgacctgttaataaagactaatagcgagaaaccaattgatgccagacagttcaagaaactgagggaagagacaatcgctgaaagtatcggcaaggagaccctcaaggacgtggaacgggaggagaaacttgaaaaggaggatcacaaatggaagctgaaaggtttgaagctaaacacgaatgggaagattcaatacaacgacctgtcttccctcgccaaatttgtacataagctgaaacagcaccttaagctggatttcttgctcgaagaccagtatactaccctggataaaatcaattttcttcagagcctgttcgtttacctaggaaagcatctccgttattcgaaccgcgtggactctgcgaacctgaaagagttttccgattcaaataaacttttcgagagagtcttgcaagaacagaaggacgatctgtttaaactcttcgagcagacagacaaggacgatgaaaagattctggcacaaactcacagtcttagcaccaaggccatgctgttggctataacaaggatgaccaacctcgacaatgatgaggacaaccagaaaaataacgataagggctggaattttgaagccatcaagaacttcgaccagaaatttattgatatcacgaagaaaaataacaatctgtccttaaagcaggacaaacggtacctggatgaccgattcatcaacgatgcaattctatctcccggcgtgaagcgcatactcagagaggctactaaggtgtttaatgccatcctgaaacaattcagcgaggaatacgacgtcacaaaggttgtgattgagcttgcgagggaattgtcagaggaaaaagagctggagaacaccaagaattatgaaaaactcatcaagaagaacagtgataaaatttccgagcggctggaagccttagacatcgcagaggacaagatagaagatatcctgaaaagccctactaagtcttacaaagtacttttgtggctccagcaggaccacattgatccatattcacagaaggagatcgctttcgaggacattctgacaaaaaccgaaaagacggagatcgatcatataattccgtacagtatcagctttgacgattcctcttcgaacaagctactggtgctcgccgaaagcaatcaagctaaatccaaccagaccccctatgagttcattacatcagggaatgccggaatcaagtgggaggactacgaagcatattgtcgcaaatttaaggatggtgacacttcactgcttgattctacccagagaagcaaaaagttcgccaagatgatgaaaacagacacttcctcaaagtacgatataggctttttggctaggaacctgaatgacacccgttacgcgacaatcgtcttccgggacgcattaaaagattatgccaacaatcacctcgtggaggacaagcctatgtttaaagttgtgtgcattaacgggggagtcaccagcttcctgcgaaagaattttgataagtcttggtacgctaaaaaggacagagataaaaacatccatcacgccgtggacgcatccattatcagtatattcagcaatgaaactaagacgctttttaaccagctgacacaattcgccgattataaattgtttaagaataccgacggctcttggaagaaaattgatccaaagactggtgtagttaccgaggtgacagacgaaaactggaaacagatcagggtccgcaatcaggtgtccgagatcgctaaggtcattaacaaatgtatccaggattcaaacattgagcggaaggccagatacagtaggaagatagaaaataaaaccaacatcagcctcttcaatgacactgtgtattcggcaaagaaagttgggtacgaggaccaaattaagcgcaaaaacctgaagacactagatatccatgaatccgcggaggaaaataaaaactctaaggtgaagaaacagttcgtatatcgaaagctggtcaatgtgagcctcctgaacaatgacaaacttgctgatttgtttgccgagaaggaggacattctgatgtaccgggcaaacccctgggttatcaatttagccgaacagatattcaacgagtacacggaaaataaaaagatcaagtcacaaaacgtgtttgagaaatatatgctcgatctgaccaaggagttccctgaaaaatttagtgaggctttcgtcaagtccatgcttcgtaataaaactgccattatctacaacgtggaaaagaaggtagtgcacagaattaaaaggctgaagatcctatctagcgagctcaaagaaaataagctgtccaacgttataattcgcagtaaaaacgagagcggcacaaagttgagttatcaggacaccatcaattctatcgcactgatgattatgcggtccatagatccaacagctaagaaacagtacatcagagtccccttaaacactctcaatctgcaccttggagaccaggattttgacctgcataacattgatgcctatttgaagaaaccgaagttcgtgaaatacctcaaggcgaatgagatcggcgacgaatataaaccttggagggtgctgaccagcgggacgctactgattcacaagaaggataaaaagttaatgtacatctcgtcatttcaaaacctcaaagacgtcatagagatcaagaatctgattgaaaccgagtacaaagaaaacgacgattctgaccccaagaagaaaaagaaagccaatcgattcttgatgacactgagtactatcttaaacgattatattctcctggacgctaaggataattttgacatccttggactgtccaaaaaccgcatagatgagattttgaatagcaagctcggtctggacaagatcaccaaatga

SEQ ID NO: 2913 - RNA, 3810 nt, synthetic construct
  misc_feature 1..3810: note = Cas9 variant
  source 1..3810: mol_type = other RNA
atgaacaatagcatcaagtccaaacccgaggtgaccattggcctggacctcggggtcggatctgttggttgggccatagtggataacgaaacaaatatcattcaccatcttggctcaagactgttcagtcaggctaagactgcagaggacaggcggagctttcgcggggtacgacgtttgatcagaaggcggaaatacaagttaaaacgcttcgtgaacctgatttggaagtataattcctactttggattcaagaacaaagaagatatcctaaataactatcaagagcagcagaagctccacaatacggtcctgaaccttaaatctgaagccctgaatgcgaagatagaccctaaagcattgtcgtggatcctccatgattacctgaagaacagaggccacttttatgaggacaatagggatttcaacgtgtacccaaccaaggagctggccaaatattttgacaagtacggttactataaagggattatcgattcaaaggaagacaatgataacaaactcgaggaagagttaacaaagtacaaattcagcaacaagcattggctggaggaagttaagaaagtgcttagtaatcagactggattgccggagaagtttaaagaagagtatgaatccctgttctcttacgtccggaactatagcgagggccccggctccattaattcagtgagtccttacgggatctatcacctagacgagaaggaaggaaaagtagttcaaaagtacaacaatatatgggataagaccattggtaaatgcaacatctttccagacgagtaccgcgcacccaagaatagccctattgccatgatcttcaacgaaatcaatgagctctctacaattcgatcctattcaatatacctgaccggctggtttatcaaccaggagttcaaaaaggcttatcttaataaactgttggacctcctgattaagactaacggggaaaagccaatcgatgcaagacagttcaaaaagttaagggaggaaacaatagccgagagcattggaaaagaaaccctgaaggacgtggagaatgaagagaaactcgagaaggaagatcacaagtggaaacttaagggcctgaaattgaacacgaatggtaagatccagtacaacgacctaagttctctggctaaatttgtccataagctcaaacaacacctgaaacttgatttcctgttggaggaccagtatgccactctcgataagatcaactttctgcagtccttattcgtgtacctggggaaacatctacggtataataaccgtgtggacagcgcgaatctcaaggaattttcggattctaaccgcctgttcgagagagtccttcaggagcaaaaagacggattgtttaagctgttcgaacagaccgataaagacgacgagaagattctcgcacagacacactccctgtcaactaaggccatgcttctggctatcaccaggatgacaaatttggataacgacgaagataatcaaaagaacaatgacaagggctggaactttgaggccattaaaaatttcgatcagaagtttatagacatcaccaaaacgaacaataacctcagtctgaagcaggataagcggtacttagacgatcgattcattaatgacgcaatcctgagccccggcgttaaacgcatcctaagagaagctactaaggtgtttaacgccattctcaaacagttctcccaagagtacgatgtaacaaaggtggtcatagagctggcgagggaactttctgaggaaaaagagttggaaaacaataagaactataagaaactgatcaagaaaaatagcgacaagatttcagaggggctcaaagccctggatatcgcagaggacaagattgaagacatcttaaaaagtcctaccaagtcctacaaggtgctgctttggttgcagcaggatcacatagacccatatagccagaaagagatcgctttcgaagatattctcactaagacagagaaaaccgaaatcgaccatattatcccgtactctatatcatttgatgacagtagctccaacaagctgctagttctggccgagtctaatcaagctaaatcgaaccagacgccctatgagttcattaccagcggaaatgccggtatcaagtgggaagattacgaggcatattgtcggaagtttaaagacggcgatacatccctcctggactcaactcagcgcagtaagaaattcgccaagatgatgaaaaccgatacatctagcaagtacgacattgggtttcttgctagaaacttgaatgatactaggtacgcgaccatcgtgttccgtgacgcactgaaggactatgccaacaatcacttagtcgaagataaacctatgtttaaggtggtatgcataaacggaggcgttacatccttcctccggaaaaattttgacaagtcatggtacgctaaaaaggatcgagacaagaacatccatcacgccgtggatgcaagcattatctctattttctccaataaaaccaagactctgtttgaccagcttacgcaattcgccgattataaactgtttaagaacacagacggtagttggaaaaagatcgatccaaagaccggggtcgtgactgaggtcaccgacgagaactggaaacagataagagtgaggaatcaggttagcaagattgctgaagagatcgataaatgtatccaggactctaacattgaacgcaaggcccggtactccagaaaaatcgagaataagacaaacatttcattgttcaatgacaccgtgtatagtgctaaaaaggtaggctacgatgaccaaataaagaggaaaaacctcaagactctggatatcgacgaaagcgtcgaggagaataaaaactcgaaggtgaaaaagcagttcgtttatcgcaagctagtgaatgtctccctgctcaacaatgataaactggcggacctttttgctgaaaaggaggatattttgatgtaccgagccaacccctgggtgatcaatctggcagaacagattttcaacgagtacacagaaaatcggaaaatcaagtctcaaaacgtatttggaaaatatatgttagacctcacgaaggagttccctgagaagtttagcgaagccttcgtgaaatcaatgctgcgtaataagaccgctataatctacaacgttgagaaaaaggtcgtgcatagaattaaaaggcttaagatcctgagttccgaactaaaggagaacaaactctctaatgtgattatccgcagcaagaacgaatccggcactaaactgtcatatcaggatacaataaatagcgtcgccttgatgattatgcggagtatcgacccaaccgcaaagaaacagtacatcagagttcccctgaacacattaaatctccacctgggggatcacgactttgatcttcataacattgacgcttatctgaagaaaccgaagttcgtgaagtacttgaaagccaatgagataggagacgagtataagccttggagggtgctcatctctggttccctgctaattcacaaacgagataagaaactgatgtacatcagctcgtttcagaaccttaatgacctcattgaaatcaagaacctgatagagactgaatacaaggagaatgtagattcagaccccaaaaagaaaaagaaagcgtctcaaatcttgcgcagtctgtccaccattttaaacgattatatcctcctggacgccaaggataatttcgacattcttggcctgagcaagaaccggatcgatgagatactcaattctaaattggacctggataagattgctaaatga

SEQ ID NO: 2914 - RNA, 3822 nt, synthetic construct
  misc_feature 1..3822: note = Cas9 variant
  source 1..3822: mol_type = other RNA
atgaagaaaatcctgggcctcgaccttgggaccaacagcattggatgggccctgatagaggtggatgaaaataacttccccatcagaattatcgctatgggttccaggattatccctttgtcttcaaatgacaaggatgagtttcagcggggcttaagtataacaaagaaccaaagccgcactgtctcccgaacgcagcgtaaggggtacgacagaaaacagctgaagaagtctgatgacttcaaatattcgctaaggcggatcctcaataagtacaacatttttccatcagaggagctgcttaaactgccgatgttggatctctggaagctgcgcagcgacgcagttaatcccaacgaaaatatcagtgccgagcagctgggacggattctctatatgttaaaccagaaaaggggctacaagtccgcgcggtctgaggctaatgccgataagaaagacaccgattatgtgctggcagtaaagggtcgctacgcccagcttaaagaccgaaaccagacaatcgggcagtatttctacgaagagttgcacaatgctaagactaccaacagctactttagaacaaaagaagaggtgtatcctagggaggcatacatagaagagttcgataccattatcaatgcccaaaagtccaaacatgactttctgactgacgaagtcgtgcaccagctacggaacgagattatctatttccagcgtaagctcaagtcacagaaaggactggttagtatctgcgaatttgagggcttcgagaagacaatttttgataaagaaaaggacaaaaacaaggtggtcttcgtgggcccaaaggtagctcccaaaaccagccctctttttcaactgtgtcgcatatgggaggttgtgaatacgatcactttgaagattaaaaacccagaagggtctaagtacaaatggggagagaagatccccaatataaaggaaaaagaggccctcgcggattatctgttcaagaacgagaccttatccttcaataaactgctcgacattcttgaactgaagaaagagaacgtctacgtgaataagcagatcatcaagggtattaaaggcaacgaaacatattcagcattgcatagaatcctaggggataatgagctgctcaagtttgacgtgagcattatacctagtaaccacacttctatgctggtcgataaaaagaccggagaaatccttgaggagagggccggcctggaattggacgtttccctcgagaaagaaccactgtaccagttatggcatacaatttacagcatcaaggatctggacgagtgcaaaaatgctctaatcaagcggttcggttttgatgacgagattgccgaaaagctctcgcacctggacttcaacaaacaagcatttgggaataagtctaacaaatccatgcgaaagatacttccgttcttgatggagggatataattactcacagagttgtaccctggctggctataaccacagcaactccctcacgaaagatgaacgcgagcaacaggtgactctggacaaacttgaactgttgcccaaaaattctctcagacaacctatcgtagagaagattctgaaccagatgatcaatgtggtcaacgccattttagaggaatacggcaagccaagcgagatcaggatagaactggcgcgggagctaaaacagtcaaaggatgaacgccatgacgccgatctccagaatagtaaaaacaagaagctgaatgaggagatcgggaaaagacttacagaattgggactgcccgtgaccaagaggtatattcaaaaatacaagtttatcttcccttccctcagcaaatctctgaaggacgcacaggttaacaatcagtgcatttattgtggtgagacttttaacttaacagaagctctgtcaggcgatgcctacgacgtggatcacatcgtcccaaagagtcttttgttcgacgatagccagaccaataaagtgctcgtacatcgtaagtgcaactccacgaaaaccaatcaaacagcttacgactatatagcctctaagggggaggaagaggttcagatttactcggcacgggtggatgactggtttaaacgaggaatcattagctattccaagatgcagagactgaaagtctcacacaaggagtacctagaaaggaagagtctgaacaaagagactgaaaccgacaagaaactctgggagaatttcatcgatcgccagctgcgggacacacaatatatatctagaaagagcaaagagatccttcagaaggtgtgtaacaacgtcactaccacagaaggcggtgtgaccgccaagttgagggatctgtgggggtgggacgatattttaatgaatctccagatgcccaaatacaaggagctgcgccaaactgttatcaaagaatggacgtccgagcacggcaagcgaaaacatcagaaggaagagattgagaactggacaaagcgggacgatcaccgtcatcacgctatcgacgcgcttgtgatagcatgcaccaaacagggatttattcagagaatcaatactctgaactcaagcgaaaccaaggatttgatgcaacaggagatcaatgaagccaaaaagctcctgggcgagaactataaagacaaggaatttgaaaattctaacgagctagtaaagaatcataaagggaggctgtccaagctcgatgactacctgcgccttcagaaaccgattaagttcaacacaaaatacgtcgaaaaggaggctgataagatcttgattagtttcaaagccggaaagaaagtggcaaccataactaagttcaaagccacaggtaagaataaagacacgggcgttatcgtgcctagaggggctctgcacgaagccggattatatggcgtcagaaccatttacagcaagggtgggatcgcagagaagcacattatcaaaaagtataaagtgggcgtatctgcgcaggaccatatatttactggaaaggaatcctactcagtgaaaaaggataagaacggcaatgagaaagttgacgataagatcaaagtcgtgctcgacagtattgtggatagcaaggtcaaagagatcgttctgaacaggcttaatttcgggttttcggacggagaagattataagaacaacgtgaagaaagctctgaataacttcaagaatctagacgagtaccccctctggtataacgaaaataaaggtattaagatcctgtccataaaattgaagacaggcctgaaggattctgtggtaccattacgactcaacgagagcaatgaggtcattaccctggtgaaaacagggaacaatcaccatatcgccatctacgaagacaagaactcaaaacctgttcaacacagttgtactttttggcacgcagtggagcgcaagaaatacaatattcccgccgtcataaagaaatcctctgatgtgtggaaccagcttctggacaaggaattgccagagagcttcctcaataacctgcccgaagacaatctaaacctgaagttttccatgcagcagaatgagatgttcgttcttggactctcacaagaggaatttaaagaggctatcgaaaacaacgataagagcctgttgagtaaatatctgtacttagtgtggtctgtatccgagaataactattggttccggcatcacctcgaaaccaagaatagcgacctgaaaaagacggagggcgccaaggagtcgaaaagactttacaacattaggtcagtctctagtctgttttccttgaatcctgtgaaggtgcgtctcaaccatctgggtgaaatcaccaaaattggggagtattga

SEQ ID NO: 2915 - RNA, 3825 nt, synthetic construct
  misc_feature 1..3825: note = Cas9 variant
  source 1..3825: mol_type = other RNA
atgaccaagcacatcctgggcctcgaccttgggacaaacagcattggatgggccataatccaggtggataataacaataacgtccccattcaaatcattgctatgggttccagaatcatacctctggactctaatgatagggaccagttccagaaaggccaggcaatctcaaagaacaaagatcggactacggcccgcacccaacgaaaggggtacgaccgtaaacagttgaagaagagtgatgactttaaatatagcttaaagaaaattctggagaagctagatatcttcccaacagaagaactcatgaaactgccgactcttgacctgtggaagttgagatccgatgcggtttctaatattgaagacatcacccccaagcagctcggaaggatactgtacatgctgaaccagaaacggggctataagtcggctcgctcagaggccaatgcagataaaaaggacacagactacgtggccgaagtaaaaggtagatatacccaactcaaggataaagggcagactttaggacagtacttttataaggagctgagcgacgctaaccagaataacacatactacagggtgaaggagaaagtctatcctcgggaagcatacattgaggagttcgatgccatcattaatgtgcaaaagagtaaacattcctttcttaccgacgaggttatccactctttgcgcaacgagatcatttattaccagcgaaagctgaaaagccagaagggcctagtgtccatatgcgagttcgaaggctttgaaacgacttatttcgataagaaaacccaacaggacaagacaatctttactgggccaaaagtcgctcccagaacctcacctctcttccagttttgtaagatttgggaggtggtaaataacatcagtctgaaaacaaagaacccagaaggaagcaagtacaaatggtctgataggatacccaccattgaggagaagcagacgatcgccaattatcttcaagaaaacgagaatctgtccttcatcgaattgctcaaaattctgcagttaaagaaagagcaggtttacgcgaacaagcagatcctgaagggtattcaaggcaatactacattttcagcaatacataaaatcattgggaacagcgaacacctcaagttcgacatcgagaccatccctagtaaacatttcgccgtgcttgtcgataagaaaactggagagattctggacgaacgggattctttggagctaaattccgctctggaacaggagccattttaccagctctggcacacaatatatagcatcaaggacctggacgaatgcaaaaaggcccttattaagcgtttcaactttgaggaggaaatcgcagagaaactgtcgaagattgatttcaataaacaggcttttggcaacaagtctaataaagccatgcgcaagatgttgccgtacctcatgctgggttataaccaatccgaagcggagtcattcgccgggtacaatagaaggttaaccaaggaggagaaaagtaagaacgtgagcgacgaacccctgcagctactcgctaaaaattccctgcggcagcctgtggtcgaaaagatccttaaccagatgataaacgttgtgaatgcaatcattgagaaatatggaaagccagaagagatccgagtagagttggcccgcgaactgaagcaatctaaagatgagagagaagacgctgataagcagaacggctttaataaaaagctcaacgagctggtggccacgaaacttaccgaactgggcttgcccacaactaagcactacattcagaagtataaattcatctttcctgcaaaggacaaaaattggaaggaggcccaagtcgctaaccagtgtatatactgcggggataccttcaatctcacagaggcgctgagcggagacaactttgatgtggaccatattgttccaaaagcattactgttcgatgactcacaggccaataaggtgctagtccacaggagttgtaactccactaaaaccaataacacagcttacgattatatcaccaagaagggtagccaggccctcaatgactacgtggcacgggtagacgattggtttaaacgcggcattatctcttatgggaagatgcaaagactgaaagtttcattcgaagagtaccaggaaaggaagaaaataggaaaggagactgaagccgacaagcgtatctgggagaacttcattgatcggcagcttcgagagacggcttatatcgccaaaaaggcaaaagaaattttggagaaggtgtgccataatgtcacaagtaccgaaggcaacgtgactgcgaaactgagacagctctggggttgggacaacgtcctgatgaatttacaactgcccaagtacaaggagcttgagaaaaagaccaaacagacatttacccagttgaaggaatggactagcgatcacgggaacaggaaacaccagaaggaggaaatcataaattggacaaagcgcgacgatcatcggcaccatgctattgacgccctcgtgatcgcatgtacgcaacagggcttcatccagagaattaacaccctgtcctcttcggatgttaaagacgagatgaagaaagaactagaggaggataagactgtgtataatgaaaggctgacactcctggagaactaccttttggagaaaaagccgtttagcaccgaagaaatcgagaaggaggccgacaaaattctggtatccttcaaggctggcaaaaaggtcgccacattatcaaaatacaaggcaactggaataaatgaaatcaaaggggtgctcgttcctcgcggacccctgcacgagcaaagtgtgtatggtaagattaaggtcatcgaaaaagataagccacttaaatacctgtttgagaactctgacaagattgtgaatcctttgatcaaacatctcgtaaagacccgactgctagaaaacgagaataacgctcaggccgcgctggtgacgctcaagaataaacccatactgcttaacaataagcagaccgagatcttggaaaaagccagctgctataacgaggctacagttctgaagtacaaattacagtccctcaaggcatcacaaattgacgatatcgtcgacgaaaagattaaattcctgatcaaggagcggcttagcaaatttggcaacaaggagaaagaagccttcaaggatatactgtggtttaatgagaagaaacagattccaatcacttctatccgtctattcgctagacccgacgccaacaatctccaggtgattaagaaacacgaaaaggggaaaaacataggatttgtgctgtccggcaataaccaccatatcgcaatttatgaggataagaataacaaattgatccagcacatttgtgacttctggcatgcggtcgaaaggaagcgcaataacatccctgttctgatagaggataccagtacaatctggaatcacttaattaacgaggactttagcgaatctttcctcaataagctgccaaacgattcccttaaactgaagttctcattgcaacagaatgagatgtttatcctcggtctgccgaaagaacagagtgaggaagccattaagagcaacaataaatcgctactgtccaagcacctttacctcgtgtggtctatcactgacggggattatttctttcggcatcacctggagaccaagaacacggagttgaaaaagatagacggcagcaaagaatcaaagagatacctgaggttaagtacaaaatccctcgtggacctgaaccccattaaggtacgacttaatcatctgggagagatcaccaagatcggcgaatga

SEQ ID NO: 2916 - RNA, 3846 nt, synthetic construct
  misc_feature 1..3846: note = Cas9 variant
  source 1..3846: mol_type = other RNA
atggaggacgatagccagcacgacatcagagaaatttacctggccatacatcacatggtgaagtataggggcaacttcctcgtcgaggggacccttgaatcctctaatgcttttaaagaggatgaactgttgaagttactgggacggatcacacgctacgagatgtcagagggtgaacaaaacagtgacattgagcaggatgacgaaaataaacttgttgcacccgccaacggccagctcgcggatgctctgtgcgccactcgagggagccgttccatgagagtggacaatgcacttgaggccctgtctgctgtaaacgatttgtcgagggagcagcgggcaatcgtgaaggccattttcgctggactcgaaggcaataaactggacctggccaagatctttgtctcaaaggagttcagcagtgaaaacaaaaagatactcggtatctattttaataaatccgattacgaggaaaagtgtgtgcaaattgttgactctgggttactggatgacgaggagcgcgagttccttgacagaatgcagggacagtataacgcgatcgcattgaaacagctgctaggcaggagcacgtccgtgtcagatagtaagtgcgccagctacgacgctcatcgggccaattggaacctcattaagctgcaacttcgcaccaaagaaaatgaaaaggatatcaacgagaattatggcatactggtcgggtggaaaattgactctggacagcgaaagtccgtgagaggtgaatcagcatacgagaacatgaggaaaaaggctaacgtatttttcaaaaagatgatcgagacaagcgatttgagtgaaactgacaagaatcggctcattcacgatatcgaggaagacaaactgtttcctatccagcgtgattctgacaacggcgttattccacatcagttacaccaaaatgagctgaagcagataatcaaaaagcaggggaaatactatccgttcctccttgatgcctttgaaaaggacggaaagcaaattaacaaaatcgagggcctgttggcgttccgcgtgccctactttgtcggtcctctagtggtgccagaggacctgcagaagtccgataatagcgaaaaccactggatggtcaggaaaaagaaaggggagataaccccctggaatttcgacgaaatggttgataaggacgcctcgggaagaaagttcattgagcggctcgtgggcacagattcttatctgcttggcgagcctaccctgcccaaaaactccttgctctaccaggaatatgaggtactgaatgaattaaacaatgtgcgactgtcagtccgcactgggaaccattggaatgacaagagaaggatgcggctaggacgcgaggagaaaacactcctgtgtcagagactttttatgaagggtcaaaccgtgacgaaaaggactgcagaaaacttgctgcgtaaggagtacggccggacctatgaactcagtgggctgagcgatgagtccaagttcacatctagcctttcaacttacggaaaaatgtgccgaatctttggcgaaaagtacgttaatgagcacagagacctgatggagaaaatcgtggaattgcagaccgtcttcgaggataaggaaacactcctgcatcagttaaggcagctggagggtattagtgaagctgactgtgccctactcgtgaacacccactatacggggtggggccgcctgtcccggaaacttttgactacaaaggctggagagtgcaaaatcagcgatgactttgccccaagaaagcactctattatagaaatcatgagggcagaggatcgcaacctgatggagattatcaccgacaagcaactcggcttctcagactggatcgaacaggagaatctgggggccgaaaacggaagtagcttaatggaggtagttgatgacctgcgagtgtcccctaaagtcaagcggggtattatacagtctatccgtcttattgatgacatctcgaaagctgtgggcaagagaccaagcaggatctttttggagctcgcggatgacattcagccgtccgggcgcactatatcacggaaaagtagactgcaagatctatacaggaatgcaaacctgggaaaggagttcaagggcatcgccgacgaactcaatgcttgttctgataaagacctgcaggatgaccgactatttttgtattacacacagctgggtaaggatatgtataccggggaagagttagacctcgaccgcctgagctccgcctacgatattgaccatatcattccccaggcagtcacgcaaaacgattcaatcgacaatcgggtgcttgttgccagagctgaaaacgccaggaaaaccgatagcttcacatatatgcctcagatagcagaccgtatgcgcaatttttggcagattctgttggataacggcctcatctctcgggtgaagttcgagagactgactaggcaaaatgagttttccgaacgagagaaagaacggttcgtacagcgcagtctagtcgagaccagacagattatgaagaacgtggcgacactgatgaggcagcggtacggaaatagcgctgccgttatcggcctcaacgcagaactgactaaggagatgcaccgataccttgggttctctcataaaaatagagacataaacgattatcaccatgcccaagacgctttgtgcgtgggaatcgccggtcagtttgcagctaaccgcggcttctttgccgatggggaggtctccgacggagcgcaaaattcatacaaccagtatctgagggactacttacgtggctatcgggaaaagctcagtgccgaggatagaaaacagggtagggctttcgggtttattgtgggcagcatgcgctcgcaggacgaacagaagcgagtaaatccaagaaccggagaggtggtttggtccgaagaggataaagactacctgcggaaggtcatgaactataggaagatgcttgtgacacagaaagtgggcgatgacttcggggcactgtacgatgagacccgctacgccgctactgaccccaagggaatcaaaggcattccttttgatggtgccaagcaagacacgtctctatatgggggattcagctcagcaaaaccagcgtacgccgtcctcatcgaaagtaagggcaaaacacgtctggttaatgtgaccatgcaggagtattccttgctgggtgatagaccctctgacgatgaattacggaaggtgctcgctaagaaaaagagcgagtacgccaaagcaaacatactgcttaggcacgtaccgaagatgcagctgattcgctatggcgggggattgatggtcatcaaatccgctggcgagctcaataacgcccaacagctgtggctaccttacgaagagtattgttactttgacgacctgtcacaggggaagggaagccttgaaaaggatgacctcaaaaagctgttggatagtatcctgggctctgtgcagtgcttatacccctggcaccgattcactgaggaggaactcgcagacctgcatgttgcctttgataaacttccagaggacgaaaagaaaaatgtgattaccggtatcgtctccgctctgcacgcggatgccaagacagcaaacttgagcattgtggggatgaccggatcgtggagacggatgaataacaagtcaggctatactttctctgacgaggatgaatttatattccaaagtccttccggtctcttcgagaaaagggttacagtgggcgaactgaagcgcaaagctaagaaagaggtaaatagcaagtacagaacgaacgagaagaggctacccaccctgtctggggccagccagccatga

SEQ ID NO: 2917 - RNA, 3861 nt, synthetic construct
  misc_feature 1..3861: note = Cas9 variant
  source 1..3861: mol_type = other RNA
atgaccaagaacatcctgggcctcgaccttgggacaaatagcattggatgggccctgatagaggtggatgaaaacaatactcccatcagaattatcgctatgggttccaggattatccctttgtctacgtcagacaaagaggagttccagcggggcttaagtataaccaagaaccaaagccgcacagtctcccgaactcagcgtaaagggtacgatagaaagcagctgaaaaagtctgacctaaagaaaatcctcaataagtataacatttttccatcggaggaactgcttaaactgccgatgttggatctctggaagctgaggtcagacagcgcaaatcccaacgagaatatcagtgccgagcagctgggacggattctctacatgttaaaccaaaaacgcggctataagtccgcgagatctgaagctaatgccgataagaaagacaccgattacgttcaggcagtgaagggtaggtatgcccagctgaaagagcggaaccagacaatcgggcaatacttctatgaggagctttacaatgctaacaccaataacagctactttcgcataaaggaggaagtatatcctcgagaggcatacactgaagagttcgacacaattatcaacgcccagaaaaataagcacgactttttgaccgatgaagtggtccatcagctgagaaacgagattatctatttccagaggaaactaaagtcccaaaagggactcgtgtcaatctgcgagtttgaaggcttcgagaaaacggtttttgataaggaaaagaataaggacaaagtggtcttcgtgggcagtaaggtagctccaaagactagccccctgtttcagctttgtcggatttgggaggttgtgaacaccatatctctgaaaatcaagaatcctgaagggtccaaatacaagtggggagagaaaacaccaaacttgaaggagaaggaaattctcgccgactatctgttcaaaaatgattcactgagctttactaagttactcgagatccttgacctgaacaaaaatgatgtctacgtgaacaagcagatattgaaaggtattaagggcaatgaaaccttcagtgcgctacacacagtgctgggggacaacgagctcctgaatttcgatgtctctatcatcccctccaaccataccagcatgcttgttgacaagaaaacgggagaaattctggaggagcgtgcaggcttggaactcgatgcctcgctggagaaggaacctttatatcaactgtggcacactatctactctctaaaagtgctcgacgagtgcaagaatgctctgattaaacgctttggtttcgatgacgagacagccgaaaaactttcccatatagattttaacaaacaggcattcgggaacaagtcaaataagagtatgagaaaaatcttgccatttctgatggagggatacgactatagccagtcctgttctctcgctggctacaaccacagcaattcactgaccaaggacgaaagggagcagcaaattactcttgatcggctggaattgctcagtaaaaactccctgcgacagccgatcgtagagaagatcttaaatcagatgattaacgtggtcaatgccatactggagcagtatggcaaactaagcgaaatccgcgtggagctcgcgagagaactgaagcaatctaaggacgagaggaacgatgccgaccttcagaatagtaaaaacaagaaattgaatgaagagattgggaagcggctggcagagctcggactgcccgttacaaaacgctacatccagaagtataagttcatttttccttcattaagcaaaaacctgaaggatgctcacgtgaataaccagtgcatctactgtggtgaaaccttcaatcttacggaggccttgtccggcgacgcttttgatgtcgaccatatagtgccaaaagccctcctgttcgatgactctcaaaccaacaaggttctagtacacagaaaatgcaactcgacaaagactaatcagaccgcatatgattacatcgggacaaagggagaagaacaggtgaggatttacagcgaacgtgtcgacgattggtttaaacggggcatcatttcctattcaaagatgcagcgactgaaagtgagtcataaggagtacctcgagagaaagaagctgggtaaagaaactgagaccgacaagaaactttgggaaaacttcatcgacaggcaattgcgcgatacacagtatatatctcggaaagccagagagattctgcagaaggtctgtaataacgtgaccactacggaagggggcatcacagctaaattaaggaatctctggggatgggacgatgttctgatgaaccttcaaatgcccaagtacaaagaactgggccagaccgtgattaaggagtggactagcgaacacgggaagcgcaaacaccagaaggaggaaatcgagaattggaccaaacgagacgatcatcggcaccatgcgatagacgcattggtagtcgcctgcacaaagcagggatttatccaacgtattaacaccctcaattcctcagatactaaagacctgatgcagagagagatcaaggaagctaagaaactactgggtgagaactataatgaaaaggagttcgaaaacgataatgagttcgtgaaaaaccacaaggagaggctcagccagctggacgattaccttcgcttgcagaaacctgttaagtttgacacaaagtatgtggaacaagaggccgataaagtcctggtgtctttcaaggcaggcaaaaaggtagccacgattaccaaatttaaggctactgggaagaataaagacacaggagtgatcgttttacggggcgccctccatgaacagtccgtctacggtaagataaaagtgattgagaaggacaaaccactgaagtaccttttcgaaaacagtaaaaagatcgtgaaccccaagatcaaagtcctggttgaggagagactagcagaaaatgagaacaatagcaagctctctctgtccaccttgaaaaagaacccgatttttctgaatgaagagaaaacagagatcttagaaaaggcgtcatgttataacgatgctactgtgctcaagtacaaactgcagagtcttaaggccagccaggcagacgatattgtggacgatagggtaaaattcctggtcaaggagcgattggcccaatttgggaataaagaaaaggaggctttcaaggacaccctctggctgaacgaagagaaacagatacctatcattacggtgcgcctatttgcccggcccgatgcaaataacctgcaggctatcaagaaagacaagaatggcagagatattggattcgttcttaccggcaacaatcaccacatcgccatatatgaggacaaagataacaagctcgtgcaacattcgtgcacattttggcacgcggtcgaaaggaagaaaaataacgtgccagccgttatcaaaaattcctctgacgtgtggaaccagctgttggacaaagagctgcctgagagcttcttaaacaagctccccattgataaactgaaacttaagttttcactgcagcagaatgaaatgttcgtattggggctcctgcaagaagacttcgaggctgcaatcgagaacaatgataagactctactgagtaagcatctttacctcgtctggtccattaccgacggagattactttttccgtcaccacctggaaacaaagaacactgagttgaagaaaaccgaaggtgccaaggagtctaaacgctattttcggttaagcacgaagggcctgatcgacctcaatccagtgaaggtgagactgaaccatcttggggaaataacaaaaattggagagtattga

SEQ ID NO: 2918 - RNA, 3864 nt, synthetic construct
  misc_feature 1..3864: note = Cas9 variant
  source 1..3864: mol_type = other RNA
atgaagaccgtgctgggcctcgaccttgggacaaacagcatcggatgggccctgattgagttggatgaaaataacatacccatcagaattgtcgctatgggttccaggatcattcctttatctacttcagacaaagaggagttccagcggggcctgagtatcacgaagaatcaaagccgcaccgtttcccgaacacagcgtaaagggtacgatagaaagcagctaaagaagtcttatctcaagaaaatactgaacaagtacaatatctttccatcggacgagcttctgaaattgccgatgctcgatctgtggaagctgaggtcagacagcgcaaaccccaatgaaaacattagtgccgagcagctcggacggatcttatatatgctgaatcaaaaacgcggctacaagtccgcgagatctgaggctaacgccgataagaaagacactgattatattcaggcagtgaagggtaggtacgcccagcttaaagaccggaatcagaccatcgggcaatatttctacggagaattgaacgatgctaatgagaacaatagctactttcgcataaaggaagaggtatatcctcgagaggcatacacagaagagttcgacaccattatcaacgcccagaaagataagcacgactttctgactgacgaagtgattcatcagctaagaaacgagatcatctatttccagaggaaactcaagtcccaaaagggcctggtctcaatttgcgaatttgagggcttcgagaaaacagtgtttgataaggagaaaaataaggacaaagttgtgttcgtcgggccaaaggtggctcccaagaccagtcctctttttcagctgtgtcggatatgggaagtagttaacacgatcactttgaaaattaagaatccagaaggaagcaaatacaagtggggtgagaaaatccccgatgtgaaggaaaaggagatactcgccgactatctgttcaaaaacgagtctttatcctttaccaagctgctcgaaattcttaaactgaataagaacaatgtctacttcaacaaacagatcttgaagggcatcaaggggaatgagacatattcaattctacacagcatcctgggagatagtgaactcctgaacttcgacgtgtctattataccttccaatcatactagcatgcttatcgataaaaagaccggcgagattctggaggaacgtgcgggtttggagctcgacacatcgctggaaaaagagccattaaaccaactgtggcacaccatctactctatcaaggatctagacgaatgcaaatccgcactcattaagcgctttgggttcgatgacgagacggccgacaaactgtcaagaatagattttaataagcaggctttcggaaacaagagtaataaaagcatgaggaagatccttccgtttttgatggagggctacgactattcccagtcttgtagcctggccggctacaaccattcaaacagtttcactaaagatgaacgggagcagcaaattacactcgacaagctggaacttctgcccaaaaattccttgcgacagcctatcgtggagaagattctcaaccagatgatcaatgtcgttaacgcaatactggaacgctatgggaagccaagcgagatcagagtggagttagctagggaactgaaacagtctaaggatgagcggaatgacaccgatctacaaaacagtaaaaataagaaactcaacgaagagattggaaagcgcctggccgaacttggtttgcccctgactaagagatacatccagaaatataagtttattttcccttcactcagcaaaaatctgaaggacgcgcacgtaaacaatcagtgcatctactgtggcgagacatttaacttaaccgaggccctgtccggggatgcattcgacgtggatcacatagtcccaaaagctcttttgtttgacgattctcagacgaataaggtgctcgttcataggaagtgcaactcgaccaaaacaaatcaaactgcctatgactacattgctaccaagggagacgaacaggtgcgtgtctacagcgagcgggtggatgactggttcaaacgaggcatcatttcctattcaaagatgcagagactgaaagtaagtcacaaggaatacctagagaggaaaaagctgggtaaggaaacagagactgataaaaagctctgggagaactttatcgaccgccagctgcgggatacccaatatatatctagaaaaagcagggaaatccttcagaaggtttgtaacaatgtggccacaaccgaagggggcgtcactgcaaaattgcgcaacctgtggggatgggacgatgtgttaatgaatctccagatgcccaagtacaaggaactgggccaaacggtcgtgaaagagtggacatccgagcatgggaagcgaaaacaccagaaggaagagattgaaaactggaccaaacgggacgatcaccgtcatcacgccatcgacgctcttgttgtggcgtgcactaagcagggattcattcagagaatcaataccctgaactcaagcgagacaaaggatttgatgcaacaggaaataaaagaggcaaagaaactcctgggtgagaattataacgaaaaggagttcgaaaataacaatgagtctgtcaaaaaccataaggaaaggctatcccagctggacgattacctccgcctgcagaagccggtaaaatttgacaccaagtatgtggagcaagaggccgacaaagttcttgtgagtttcaagagcggcaaaaaggtcgctactattacaaagtttaaagccacggggaagaataaagataccggagtgatcgtacctcggggcgcattgcacgaacagaacgtgtacggtaagatcaaagttattgagaaggacaaatctctgaagtacttattcgaaaattccgagaagatcgtcaaccccaaaattaagaacatagtggaaatcattctctcagagaatgagaacaatagtaaaatggccctgagcactcttaagaaaaacccaatctttctgaatgaagagaagacagatctactcgaaaaggcttcgtgttatgagtacgtgaccgtcagaaaatatcctctgaacacaattaaggcctcccaggcagacgatatcgttgacgagagggtgaaattcttggtgaaggaacgactgactcagtttgggaataaagagaaggaagcgttcaaggataccttatggtttaacgaggaaaaacaaatacccatcattacggtacgcctcttcgctcggccagacgccaataacctgcaggcaatcaagaaagatgagtctggcaaggagattggatttgtcgtgatgggcaataaccatcacatcgccatatacgaagacaaagatgggaaacttgttcagcacagctgcaccttctggcatgctgtggagagaaagaaatataatatttcaacagtcatcaagaacagttccgacgcctggaatcaatttctggacaacgaattgcccgagcctttcctcaataaactgccagcagataacctaaacctgaagttctctcttcagcagaatgaaatgtttatcctcggactgagccaggaggagttcgacaaggctttgaagtccaacgataaatcactgttaagcaagcacctctacctggtgtggagtatttctgaaaataactattggtttaggcatcaccttgagactaaaaattccgacctgaaaaagaccaacggtgttaaagaaagcaagcgtttgtacaatatacgctcgctcggctcactgttctctctaaacccgatcaaaattcggctgaatcaccttggggagatcacaaagattggagaatacagttga

SEQ ID NO: 2919 - RNA, 3867 nt, synthetic construct
  misc_feature 1..3867: note = Cas9 variant
  source 1..3867: mol_type = other RNA
atgagactgttcgaggaaggccacaccgccgaggacaggcggctcaagcgcacagctcgacgtagaatcagcaggcggcgcaacagacttaggtacctgcaggcatttttcgaagaggccatgactgatttggacgaaaatttcttcgcgcggttacaagagtcctttctggtgcccgaggataaaaagtggcatcgccaccctattttcgctaaactagaagacgaggtcgcctatcatgaaacgtacccaaccatatatcacctccgaaagaaactggcagattcttcagagcaggccgaccttagactgatctacttggctctcgcacatattgttaagtatagggggcactttctgatcgagggaaagctgagtacagaaaacactagcgtgaaagatcagttccagcaatttatggtaatttacaatcagaccttcgtgaacggtgagtcccggctcgtctctgccccgttacccgaatcggtgctgatcgaggaagaacttacagagaaggcttcacgtaccaaaaagagcgaaaaagttttgcagcagtttcctcaagagaaggccaatggcctgttcgggcagtttctaaagctcatggtgggaaacaaagcggacttcaagaaagtcttcggcctggaagaggaagcaaagataacttatgccagtgagtcctacgaggaagatcttgagggtatcctggctaaagtgggggacgaatactctgatgtatttttggccgcaaagaatgtttatgacgctgtggagctcagcacaattctggccgattccgacaaaaagtcacacgcgaagttaagtagctctatgatcgtccgcttcaccgaacatcaggaggacctgaaaaagtttaaaagattcattagggagaactgcccagatgaatacgacaatctctttaagaacgagcagaaagatggatatgccggctacatcgcacacgctggcaaggtgtcccaacttaagttctatcagtacgtgaaaaagataattcaggacatcgccggggctgaatattttctggagaaaattgcccaagagaatttcttgcggaagcagcgaacgtttgataacggagtcatcccccatcagatccacctagcagaactgcaggccattatacaccgccaagctgcgtactaccctttcctcaaagagaatcaggaaaagatcgagcagctggttacttttaggattccatattacgtgggtcccctttcaaagggcgacgcaagcaccttcgcctggctgaaaagacagagtgaggagcctatccggccatggaacttgcaagagacagtagatctcgaccagtctgctactgcctttatagaacgcatgaccaatttcgatacatatctgccgtccgagaaggtgttacccaaacatagcctgctatacgaaaagttcatggtctttaacgagctcaccaaaatttcgtatacggacgatagagggatcaaggcaaacttctctggaaaggaaaaagagaagatctttgactacctgttcaaaactaggcgtaaggtgaaaaagaaagacattatccagttttatcggaatgagtacaacacagaaattgttaccctttccggcttggaggaagatcagttcaatgcctcatttagtacttaccaagacctgctcaagtgtggtctgacacgagctgagcttgatcaccctgacaacgccgaaaagctggaggatataatcaaaattttgaccatcttcgaggacagacagaggatccgcacgcagctcagcacctttaaggggcagttctccgcagaagtgctgaaaaagttagagcggaaacattatacaggatggggcagactgtctaagaagctaattaatggcatatacgataaagaaagcgggaagactatcctcgactatctggtcaaagatgacggagtgtcaaagcactacaacaggaattttatgcaacttattaacgatagtcagttgtccttcaaaaatgcgatccagaaggctcaaagctctgagcatgaggaaaccctgtcagagacagtaaacgaactcgccggtagtccagcaattaagaaaggcatctatcagagcctgaagatagttgacgagttagtggccatcatggggtacgctcccaaacgcattgtcgtggaaatggcccgagagaatcagactacctccacaggaaagcggcgttctatccagagactgaaaattgtcgagaaggcaatggctgaaatcggctcgaaccttttgaaggagcaacctaccactaatgaacagctcagggatacgcgcctgtttctatattacatgcagaacggtaaagacatgtacacaggggacgagctgagcctccaccggctgtcccactatgatatagaccatattatcccacagtcattcatgaaggatgacagtcttgataatttggtgctggttggctctaccgaaaacagaggaaaaagcgacgatgtgccctccaaggaggtagtcaaagacatgaaggcctactgggagaaattatatgcggccggcctcatttcacaaaggaagttccagcgactgactaagggggaacagggaggtcttaccctggaggataaagctcactttatccagcgccaattggtggaaacacggcagataaccaagaacgttgcaggcatcctcgaccagagatacaatgccaaaagcaaggagaaaaaggtgcaaattatcactctgaaggcttctctaacatcccagttcaggagtatttttgggctgtataaagtccgtgaagtgaacgattaccatcacggacaggacgcctatctcaattgcgtagtggcaacgaccctgcttaaggtttacccgaacttggcgcctgagttcgtctacggcgagtatcccaaatttcagactttcaaggaaaataaagccacagctaaggccatcatatacaccaacctgttacgctttttcacagaggatgaaccacggtttactaaggacggtgagattctctggagcaattcttatctgaaaaccatcaagaaagagcttaactaccaccaaatgaatatcgtgaagaaagtggaagtccagaaagggggcttctccaaggagtcaattaaacctaagggacccagtaacaaactgatcccagttaagaatggcctagacccccagaaatatgggggatttgatagccctgtggtggcatacacggtactcttcacccatgaaaagggtaagaaaccactgattaagcaggagatattgggcatcacaattatggaaaagactagattcgagcaaaacccgatcctgtttttagaggaaaaggggttcctcaggccccgagtcctgatgaaacttcctaagtataccctgtacgagtttccagaaggacggcgcagattgctcgcttcggccaaagaggcacagaagggcaatcagatggtgctgcccgaacacctactgacacttctctaccatgccaagcagtgtctgttgcctaaccaatccgagtctctggcttatgttgagcagcaccagccagaatttcaggagattttagaaagggtggtcgactttgcggaggtgcatactctcgccaaaagcaaggttcaacagatcgtgaaactgttcgaagcaaatcagaccgctgatgtaaaggagatagccgcctcatttatccaacttatgcagttcaacgctatgggtgcacccagtacgtttaaattctttcagaaggacattgagcgggcccgatacacatccatcaaggaaattttcgatgcgaccatcatatatcagtctccgactgggctgtacgagacaagacgcaaagtcgtggactga

SEQ ID NO: 2920 - RNA, 3903 nt, synthetic construct
  misc_feature 1..3903: note = Cas9 variant
  source 1..3903: mol_type = other RNA
atgtggggcgtgagcctgttcgaggccgggaagaccgctgcagaaagaaggggataccggtccacacgccgacgtctcaaccacagaaaatttaggcttcggctgttggaggacatgttcgaaaaggagatcttatctaaagatccctcatttttcattcgcctgaaggaagcctttctaagtcctaaagacgagcagaagcaattcaagggtaatatactctttaacgataaagactatactgatgcggactactatgagcagtacaagacgatctatcatctgagatacgatcttattagccagcacaggcagttcgacatccgggaagtctatctggctattcatcacttgatcaaataccgcggccattttatatacgaggatcaaaccttcacaactgacgggaatcagctccagcaccacatcaaggccattatcaccatgattaactccacactgaatcgaatcataattccagaaaccatcgatattaacgtttttgagaaaatcctgctcgacagaatgatgaataggtcttcgaaggtgaagttcttaatcgagctgactggagaagataaacaggacaagccgcttttgaaagagctgtttaacctaattgtaggcctcaaggcaaaacccgcctcaatattcgaacaagagaatctggctacaatcgtggaaaccatgaacatgagcacggagcaggtccagcttgacctgttgactctcgcagatgtgctggccgacgaggaatatgatttactgctcaccgctcagaagatttacagtgccatcatacttgacgagtccatggatggttatgaatacttcgcggaggcaaagaaggaatcttatcggaagcatcaagaggagctggttttggtgaaaaagatgctaaaaagcaatgccattacaaacgacgaacgtgctaagtttgagtacttctatactgattacatcggggccaaatcctcaaattacgaagagagtaagaacatcaagaaaggactgagcgcagcttatggcaagtactctaaagaagaacgcctctttaagcacattgagctgcttctggccaaagaaaatgtcttgaccacagtggagcatgcgctcctggaaaagaacatcaccttcgcctccttactgcctctacagagatcaagcaggaacgcagtaattccatatcaggttcacgagaaggagctcgtggctatactggaaaatcaagccacgtactatccctttcttttggagcagaaagacaacatccacaagctgctcactttccggattccttactatgtcggcccactggctgatcagaaagacagtgaatttgcctggatggtgcgaaagcaggcagggaaaatcacacccttcaattttgaggaaatggtggatatcgacgcctcttccgaggctttcattaagcgcatgaccaacaagtgcacttaccttatacatgaggacgtcatccctaaacacagcttttcgtacgcgaagttcgaagttctgaatgagttgaacaaaattagactcgatggaaagccaatcgacattccgctgaaaaagaggatctttgaaggtttattcctggagaaaacaaaggtgacccaaacgtctctaaagaaatggctcgcagaacatgagcacatgaccgtatccgtggtccagggcacacagaaggagactgagttcgccacctcactgcaggcttttcatcggttcgtgaaaatatttgatcgcgagacagttagtaatcccgccaacgaagagatgttcgaaaagatcatttattggagcactgtgtttgaggacaaaaagatcatgagaaggaaactttccgagtaccctcaattgaccgaacagcagcaggtccaactggcacaggtgcgtttccgggggtggggacgactctctcagagactgattaataggatcaaaacaccagtaagcggcgatgaggaccacaagttatcaataaacgaaattctgtggcagaccaatgagaactttatgcaaatcattcgcaataaagattatcttttcaagaaaatcatagaggaacagtttgagaacgaaactgccttgctcaataagcagcggatcgacgagctggctgccagtcccgcaaacaagaaaggtatttggcaagcgatcaagattgttaaagaactagagaaggtgctgcagcagcctgctgagaacatcttcatagaatttgccagatccgatgaggaaagcaaaaggtctacgccacgcgacaagttcattgagaaggcatacgcccagctcaaaaaggaaacagatacctttaatctggagcaccttaaagagttgaagcaacgatcaaaacagctgagtagccagcggttattcctctatttcatccagaacgggaagtgtatgtactccggagaacatctggacatcgagcgtcttgattcttatgaagtcgaccacattctgccccaatcgtacatcaaagacaatagcattgagaacttggctctcgtgaagaaggtcgaaaatcagaggaaaaaggattccctgctactgaactcaagtataatcaatcagaactactctagatgggagcagctcaaaaatgccggcctgattggcgagaagaaatttcgcaaccttactcggaccaagatcacagacagagataaggaagggttcattgcaaggcaattggtggagacccgacagatcactaaacatgttacacagctgttacaacaggaatataaggacacgaccaaagtgtttgctataaaggccactctcgtaagcggactgcgccggaaattcgagtttatcaagaatagaaacgtcaatgattaccaccacgcgcaggacgccttccttgtggcttttctgggtacaaacattacctccaattatccgaagatcgagatggaatacctattcaaaggctatcagcattacctcaacgaggttgggaagtcagcagccaaacctaagtttacattcattgtggaaaacctgagcaaacaacagtataattctactaccggagaggtcaagtggaaccccgaagtggatatcgctaagttgaaaaggatactgaattttaagcagtgcaacattgtacgtaaagtggaggagcagtccggcgccttattcaaggaaacgatctacccagttgaggaaagtagctctaaaaccatccctctcaagaagcacctggacacagcaatttacggtgggtatactgcggtcaattacgcctcctatgctcttatacaattcaaaaagggccgcaaactgaagcgggagatcattggaatccccttggccgtgcagaccagaattgataactcagaaacaagtctccaggcatacatcgctgagcagataaaaagcgaggtggaaatcctgaatggcaggattctaaagtatcaactgatctcgaacaatgggaaccgactttacattgccggaccatccgagcggcataatgcacgccagctcatcgtctctgacgaagccgctaaagttatatggctgattagcactaagcaggcggatgaggccatgtttttgaagtattacagactggaacacttagaggcagtgttcgaggaactcatcaggaaacaggctgccgactaccaaatctttgagaagctgattaaaaagatcgaagtgaacaaagtatatttctactcatgtacctataatgagaaggtcaaggtgatagaggaacttctgaaaattacgcaggccaacgctacaaatggtgatttgaagctcctgaaaatgagtaaccgggagggccgactagggtccgtttctgtggcactggactttaagatcattaaccagagcgtcaccggactttaccaatccatcgaagactataataactga

SEQ ID NO: 2921 - RNA, 3930 nt, synthetic construct
  misc_feature 1..3930: note = Cas9 variant
  source 1..3930: mol_type = other RNA
atgggcagcgtggggttcgccggaatcgacaaccagtacaatctggtcagaaccaagggtaaaaacgttattggcgtgaggctctttgatgaggctgactccgcagccgaacggcgcgggcaccgaacaaatcgtagaaggcttcaacggcgcagatggaggctgcggttgttagatgacatattcgcgaagcccctgcaggctgtagatcctaactttctagcccgcctcaaatattcttacgtgaataagaaagaccagggacagcaagatcattattacggcggttatgtcttcgggtcaactgcagccgaccaggcttaccaccaggcatatccaacgatctaccatctgcgaaagagacttatggaggatgaccagaagcacgatctgagggaagtgtacttggccattcatcacatcgttaaatatcggggaaactttctcaatccgcaaagtagcctggacattgatcagcagttcgacgtgaccgactttgctcaggccctggcgcgtttcgcagatcaccaagccctctcctgggctttagaggcccccatccgctttctggaagcagagcttgctacaggcttgtctaactcggccagagtcgacgcggccatagaggcattctcatttgatactaaggtggacagggctgccatcaaagaaatgctgaagggcctaagcgggaatcagattgatttcaccaaactctttgtaaacgttgacagtgctgattgggaccaggaggaacggaagcaatggaagatgaaactgtccgaggaggatttcgacgaacaggcccttcctatcctggagcgattgtctcaggatgaaacagagttctttctcgcaattaagcgcgcctacgacggaatcgctctgatgagattcttaggtgacgaacagagcctgtcctcagcgatgataaaagcatatgaggatcataggcgggacctcacctttcttaagactcaagtgcgcacaccacagaatagacaggccctgagtgagggctacaccaactatttgagcgtcgatgacaaaaagcacaaaagaggggctaaggaactagcccagctgattgaggcatctgatgcctccgaacaagacaaggctacgatgctcgatcgtatcgccaatgaccagttcgcacccaaacagcggactaaggcgaacggactgattccttaccagcttcatctggctgagttgaaaaagatcctcgccaaacaaggccagtattacccatttctgttagataccttcgcaaagcagggtcagtcagtgaataagatcgaggagctggtgcaatttcgagtcccctactatgttgggcctatggtgccaaaaagcgagacagccggaaacgctgaaaaccactgggtagagaagaatgacggccagactaaagtgagtgtcaccccgtggaacttcgatcaggtgtttaatagagacagggccgcaaagtctttcattgatcgcctaacaggcaccgacacgtacctcataggggaacccactctgcctcggcactcccttacatatgagacctttactgttttgaacgaactgaataacatcagaattgacggaaaaaggctcccagtggagacaaagcaagctatcgtcgaggatctgttcaagaaataccgccttgtgaccaagaaacgactgcaggactattttgccagcttcggtaagcgggaagtagagttgacgggcctcgcggatgaatcgcgtttcacctcttccctgacatcataccatgacttacaggggctgctaggaactgattttataaccaatccccagaaccacagtctcctggagaaaattgttgagatccaaacagtgttcgaagacagcgatatcgccgagagagaacttggcaagttgggtctggagcagaagctcattcctaggctggctaaaaagcattatactgggtggggcaatttatcccgcaaactgcttgacacctcttttatccacgatccagaacggcccgaggagccggtcagcattatggacttgctctacacaaccaacaagaatttcatggaaatactgcatgattcagagtacggagtggaagagtggctaaaaagtcagaacatgatcgacgatcagaaggacattcaaatgagaatcgacgaactgactacgtcccctgcaaataaaaggggcatcaagcaggcctttaacgtcctcgatgacattacacaggctatgggggaggagcccgcctatgtgtacctggagttcgcacgagaaaagcaggcgagccgccggaccgtttctaggaaaaagaggcttgaaactttgtataaaaatgccgctctgaagaccgagtttaaagccataaaggaagcattagctgaggagtcagatgaccgtatgcaagatgaccgcctctacctgtattacgcccagcttggacgggatatgtatacaggtcagagtatcagcattgaccaactgtcctctcactacgatatcgaccacattgtgccaagagcattcatcaaggatgactcgttggaaaacaaagtactcgtcaacaggaccgacaatgcccgaaagactgatagcgctacatttacggcggacgtgaaagccaaggcattccctctgtggcagcagctaaagaagctgggcctcatatccgctaagaaatttcggctgcttacccgcactggggatttcacagagatggaaagagagaggtttatcgcccggcagttggttgagacccgacaaattatcaagaacgtggccgctctgattgaaggacatttctcacagacacaggcagtcgccatcagagcggaggtgactggcgaattacgccagctcacccaaattaaaaaggacagggatataaatgactaccaccatgctcaggatgccctgcttgtagcaacggccggtacctatctgcaccgtcacttccccaaacgggacgctagatttatctacaacgagttcgattattacacacagcattggctaaagaatcagggggaaaacaggcgccgacacccatatagttttgtggttggcactatgtctaagggaaatgaggactggacccccgataacctcaattacctgagaaaagtcatgcaatataagacaatgttgatgactcggaaacctgtgggcccagagggggcactgtacaaggaaaccttaattgccgcggacccgaaaaagaggctcgtgggagctagcaaagagcgccaggatcccacgatctacggtggctatacaaaggaatcctcagcctacatgagcctggtccgtgcagggggaaagaaccagcttgttaaaatacctgtgagaatcgccaatgagattcattctggccagcggaagctggacgactatgtgcaagctaaagtaaagaaattcgaaaggatcttgctcccaaagatttccctgggtcagctagtcgaggatgaggggcagcgcttttacctggccaccaacgaaatgaagcacaatgcaaaacaactttggctcgaccagaaggtggttactacatataaacgactgaccgctgagagtcccgtggaagatttcttgactgtctttgacgccctgaccagctctgcgacaatccatcacttcaagttttaccagagagatttagagctcctgcgggacaacagggccggcttccaggatcttgcaaaagctacgcaactgaaggtgttgaaggacgttctctatgaactgcacgataatgccggatggcgcgaccctataaaacagtactttaaggagattggcctaaaagtgagaatgtggaccaagctgcagaaagaagggggaatcaaacttactgatcaggctgaactcatctaccaatccccatcaggcctgttcgagaagaggcggcgtgtacaggacttgttatga

SEQ ID NO: 2922 - RNA, 3939 nt, synthetic construct
  misc_feature 1..3939: note = Cas9 variant
  source 1..3939: mol_type = other RNA
atgcagaacggcttcctggggatcaccgtgagctccgagcaagtcggatgggccgttacaaatcccaagtacgaactcgagagagcttctaggaaagacctttggggtgtgcggctgtttgataaggcagaaactgccgaggaccgccgaatgttccgtacgaacagaaggttgaatcagcggaaaaagaaccgcattcactatttaagagatatatttcatgaagaggtaaatcagaaagaccctaacttctttcagcaactggatgagtcaaatttctgcgaagacgataggaccgtggagtttaacttcgacacaaatctatacaagaaccagtttccaactgtctatcacctccggaagtacctgatggaaaccaaagataagccggacatccgccttgtgtatctggcgttcagtaaatttatgaagaatcgaggccatttcttgtacaaagggaacctcggagaggttatggattttgagaatagcatgaagggcttctgtgaatccctggagaagttcaacattgactttcccacactgtctgatgaacaggtgaaagaggtcagagacatcctctgcgaccacaagattgctaaaaccgtgaagaaaaagaatatcataactatcacaaaagtaaagtcgaagaccgccaaagcatggattggtttattctgtgggtgctcagttcctgtgaaggtcctgtttcaggatatcgacgaagagattgtgacggatccagagaaaatcagcttcgaagacgccagttatgatgactacatagctaacattgagaagggagtgggcatctactatgaagcaattgtctccgccaaaatgctttttgattggtctatcatgaacgagatcttgggcgaccatcaactgctaagcgatgctatgattgccgaatacaataagcaccacgacgatctcaagaggctgcagaaaataatcaaggggactggatcccgggagctttatcaggacattttcatcaacgacgtttcaggtaattacgtgtgttatgtaggccatgcgaaaaccatgagtagcgcagatcagaagcaattttacacattcctgaaaaaccgtttgaagaatgtgaacgggatatcttccgaggacgccgaatggattgatactgagatcaagaatggaaccctcctgcccaaacagacaaagcgcgacaactcagtcatccctcaccagttacaactgagagaatttgagctcattcttgataatatgcaggaaatgtatccattcctgaaagagaacagggagaagttgctaaaaatctttaatttcgtgattccctactacgttggccctctgaagggtgtggtccggaagggggaaagcaccaactggatggtgccgaaaaaggacggagtaatacatccatggaattttgatgagatggttgacaaagaagctagtgccgagtgcttcatctctcgaatgacgggcaactgttcctatctcttcaatgagaaggtgctgcccaaaaacagccttctgtacgaaacttttgaggtcttgaacgaactcaatcctctgaagattaacggcgagccaatctcggtggaattaaaacagcgcatctatgagcagctgttcctaacagggaagaaggtcaccaaaaagtctctcactaaatacctgattaagaatggatatgatgaggacatagaactttccggtatcgataacgagtttcactcaaatttgaaaagtcacattgacttcgaagattacgacaacctgagcgacgaggaagtggagagaatcattctcaggatcacagtttttgaggataagcaactgcttaaggactatctgaatcgggagttcgtgaaattgtccgaagatgaacgcaagcagatatgctctctcagctacaaaggctgggggaacctgtcagagatgttactgaatggaatcaccgtaacggacagtaacggcgtcgaagtgtccgttatggatatgctatggaataccaacctcaatctgatgcagattcttagcaagaaatacggttataaggcagagatcgagagatacaacaaggaacatgagaaaaatatttataacagggaagacttgatggattacctgaacataccccctgctcagcgtcggaaggtgaatcaactcatcacaattgtcaaatctctgaagaaacgatgtggggtgccaaacaagatctttttcaaggtatcaagagagcaccaggacgatcccaaaaggaccagtagccgcaaggagcagttaaaatatctgtacaagtcccttaaatctgaagacgagaagcatttgatgaaagaactcgatgagctgaatggccacgaactatcgaacgacaaggtgtatctgtactttctccagaagggacggtgcatttacagcggcaaaaagctgaatctttccagattgaggaaatcaaactatcaaaatgatatcgactacatatatccgctgagtgccgttaacgaccgctctatgaataacaaggtcttaactgggatccaggagaatcgagcggataaatacacatatttccctgtggaccccgagattcagaagaagatgaaaggattttggatggaactcgtgctgcagggtttcatgagcaaggagaaatactttcggctttcccgtgaaaacgatttctcagagaatgaactggtcagcttcatcgagagagagatttctgacaaccaacagtccggcaggatgatcgccagtgttttgcagtattactttccagaaagcaagatagtgttcgtgaaagagaagctcatttcttcctttaagcgcgatttccatctgatctcaagttacgggcacaatcacctacaagcagctaaagacgcctatatcactattgtagtcggaaacgtgtaccataccaagtttacaatggatcctgctatctatttcaaaaaccacaagcggaaagactacgatctgaatagactctttctggaaaacattagcagggacggccagatagcctgggagtcgggtccctatgggtccatccagaccgttcgaaaggaatacgcacagaatcatattgccgtgactaagcgcgtcgtggaggttaaaggcggacttttcaagcaaatgccattgaaaaagggccacggggagtatcccctgaaaacgaacgatcctcggtttggaaatatcgctcagtacggtggctacacaaacgtgaccgggtcttatttcgtattagtcgaaagcatggagaagggaaagaaaagaatttcactcgaatacgtgccagtgtatctgcacgagaggcttgaggacgacccgggccataagctgctaaaagaatacctcgtcgatcaccgtaagctgaatcatcccaaaatcttgctggcgaaggttcgcaaaaacagtttactcaagatagacggtttttattaccggctgaatgggagatccggcaacgcacttatcctgactaatgccgtggagttgattatggatgactggcagaccaagacagctaacaaaatctctggatatatgaagaggcgagccattgataaaaaggcacgggtataccagaatgagttccacatccaagaactcgaacagctgtacgacttctatctagataaactggagaacggcgtgtacaagaatcgcaagaacaatcaggccgagcttatacataacgaaaaagagcagtttatggaactcaagaccgaggaccaatgtgtcctgttgactgaaattaaaaagctgttcgtgtgcagccctatgcaggctgatttaacactcatcgggggatccaaacacacgggcatgatcgccatgtcaagcaacgttaccaaggcagactttagtattatagcggaggatccactgggtcttagaaataaggtgatctattctcacatgggggagaaatga

SEQ ID NO: 2923 - RNA, 3939 nt, synthetic construct
  misc_feature 1..3939: note = Cas9 variant
  source 1..3939: mol_type = other RNA
atgcagaacggcttcctggggatcaccgtgagctccgagcaagtcggatgggccgttacaaatcccaagtacgaactcgagagagcttctaggaaagacctttggggtgtgcggctgtttgataaggcagaaactgccgaggaccgccgaatgttccgtacgaacagaaggttgaatcagcggaaaaagaaccgcattcactatttaagagatatatttcatgaagaggtaaatcagaaagaccctaacttctttcagcaactggatgagtcaaatttctgcgaagacgataggaccgtggagtttaacttcgacacaaatctatacaagaaccagtttccaactgtctatcacctccggaagtacctgatggaaaccaaagataagccggacatccgccttgtgtatctggcgttcagtaaatttatgaagaatcgaggccatttcttgtacaaagggaacctcggagaggttatggattttgagaatagcatgaagggcttctgtgaatccctggagaagttcaacattgactttcccacactgtctgatgaacaggtgaaagaggtcagagacatcctctgcgaccacaagattgctaaaaccgtgaagaaaaagaatatcataactatcacaaaagtaaagtcgaagaccgccaaagcatggattggtttattctgtgggtgctcagttcctgtgaaggtcctgtttcaggatatcgacgaagagattgtgacggatccagagaaaatcagcttcgaagacgccagttatgatgactacatagctaacattgagaagggagtgggcatctactatgaagcaattgtctccgccaaaatgctttttgattggtctatcttgaacgagatcctgggcgaccatcaactactcagcgatgctatgattgccgaatacaataagcaccacgacgatctgaagaggcttcagaaaataatcaaggggactggatcccgggagctgtatcaggacattttcatcaacgacgtttcaggtaattacgtgtgttatgtaggccatgcgaaaaccatgagtagcgcagatcagaagcaattttacacattcttgaaaaaccgtctcaagaatgtgaacgggatatcttccgaggacgccgaatggattgatactgagatcaagaatggaaccctgttacccaaacagacaaagcgcgacaactcagtcatccctcaccagctgcaactcagagaatttgagcttattctggataatatgcaggaaatgtatccattcttgaaagagaacagggagaagctactgaaaatctttaatttcgtgattccctactacgttggccctctcaagggtgtggtccggaagggggaaagcaccaactggatggtgccaaagaaggacggagtaatacatccgtggaattttgatgagatggttgacaaagaagctagtgccgagtgcttcatctctcgaatgacgggcaactgttcctatctgttcaatgagaaggtgcttcccaaaaacagcctgttgtacgaaacttttgaggtcctcaacgaactgaatcctttaaagattaacggcgagtcgatctctgtggaactgaaacagcgcatctatgagcagctattcctcacagggaagaaggtcaccaaaaagtccctgactaaataccttattaagaatggatatgataaagacatagagttgtcaggtatcgataacgaatttcacagtaatttaaagagccacattgacttcgaggattacgacaacctctccgacgaagaggtggaacaaatcattctgagaatcacagtttttgaggataagcagcttctgaaagactatttgaatagggagttcgtgaagctctctgaagatgagcggaaacagatatgcagcctgtcatacaagggctgggggaacttaagtgaaatgctgctaaatggaatcaccgtaacggactccaacggcgtcgaggtgagcgttatggatatgctctggaataccaacctgaatcttatgcagattttgtctaaaaagtacggttataaggcagaaatcgagcattacaacaaagagcacgaaaagacaatttataatcgcgaggacctgatggattacctcaacatcccacccgctcaaagaaggaaagtgaaccagctgataactattgtcaagtcactgaaaaagacctatggggtgcctaataagatctttttcaaagtaagtcgtgaacatcaggacgatccaaagcggacaagctcccgaaaagagcagctgaagtacctttataaatctttgaagtcggaggacgaaaaacacctcatgaaggagctggatgaactaaacggccatgagctgagcaatgacaaggtgtacctctactttctgcaaaaaggaagatgtatttattccggcaagaaacttaacttgtcaaggctgcgcaagagtaattaccagaacgatatcgactatatataccccttatctgccgttaatgaccggagcatgaacaataaagtcctcactgggatccaggaaaacagagcggataagtatacctacttcccggtggaccctgagattcagaagaaaatgaagggattttggatggagctggtgcttcaaggtttcatgtccaaagaaaagtattttaggctgtcacgcgagaatgatttcagcgaaaacgagttggtctctttcatcgaacgagagatttccgacaatcagcagagtggccggatgatcgccagcgttctccaatactactttcccgagtctaaaatagtgttcgtgaaggaaaagctgatttcctcatttaaacgtgatttccacctaatcagtagctatgggcacaaccatctgcaggcagctaaggacgcctacatcacaattgtagtcggaaatgtgtatcacgctaaatttaccatggatccagccatctacttcaagaaccataaaagaaaggactatgatctcaacaggctgtttcttgagaatatttcgcgcgacggccagatagcatgggaatccggtccttacgggtctatccagactgttcggaaggagtatgcccaaaaccacattgctgtgacgaaaagagtcgtggaagttaagggcggattgttcaaacagatgcccctgaagaaaggccacggggagtacccattaaagacaaatgatcccaggtttggaaacatcgcgcagtacggtggctataccaatgtgactgggagctacttcgtactcgtcgagtcaatggaaaagggcaaaaagcgaattagtctggagtatgtgcctgtgtaccttcatgaacgcctggaggacgacccaggacacaaactactcaaggagtatctggtcgatcatcggaaattgaaccacccgaagatcctgttagcaaaagttagaaagaactccctcctgaagatagacggtttttactataggcttaatgggcgttctggcaatgccctgatcttgaccaacgctgtggaactcattatggatgactggcagacaaaaaccgccaataagatcagcggatacatgaaacgccgggcaattgataagaaagccagagtataccaaaacgagttccatatccaggaactggagcagctatatgacttctacctggataaacttgaaaatggcgtgtataagaacaggaaaaataaccaggctgagctcatacacaatgagaaggaacaatttatggagctgaaaactgaagaccagtgcgtcttgctgacagagattaagaaattattcgtgtgttcccccatgcaggccgatctcacgctgatcgggggatcaaagcacaccggcatgatcgcaatgagcagtaacgttactaaggcggactttgctgtgattgccgaagatcctcttggtctgcgaaacaaagtcatatactctcatatgggggagaagtga

SEQ ID NO: 2924 - RNA, 3942 nt, synthetic construct
  misc_feature 1..3942: note = Cas9 variant
  source 1..3942: mol_type = other RNA
atgcactacctggacgagatcttcgctccccatctccaggaagtggatgagaactttcttagaaggctgaagcaaagcaatattcaccctgaagacccagccaaaaaccaggcattcataggcaagttgttatttccggatctgctaaagaagaatgagcgggggtatcccaccctcatcaaaatgcgcgacgaactgcctgtcgagcagcgagcccattacccagttacaaacatttataaacttcgtgaggcgatgatcaatgaagatagacagttcgacctgagggaggtgtacttggctgtacaccatattatgaagtatcggggacactttctcaacaatgcctccgtggataaattcaaggtcggtcgcatcgacttttacaaatctttcaacgtgctgaatgaagcatatgaggagctgcaaaacggcgaagggtcatttactatagagcccagtaaggttgaaaagatcggacagctcttactggatacgaagatgagaaaacttaataggcagaaagccgtggctaagttgctggaggtcaaagtggcagacaaggaagagaccaaacggaacaagcagattgccacagctatgagcaagctagtactcggctacaaggccgatttcgcgactgttgcaatggccaatggtaacgagtggaagatcgacctgtcctctgaaacctcggaggatgaaattgagaaatttcgcgaggaactttcagacgctcaaaatgacatcctgacagagataaccagcttgttcagtcagattatgctcaacgaaatcgtgcctaacgggatgtccatttctgagagcatgatggatcgatactggactcacgaaagacagctggccgaggtcaaggaatatttagcaacacagccagcttccgccaggaaagagtttgaccaagtgtacaataagtatatcggacaggcgcccaaagagcggggcttcgatctggaaaagggcctcaagaaaatcctttcaaagaaagagaactggaaggaaattgacgagctgttgaaagccggggatttcctacctaagcagcgtaccagtgcaaatggagtgataccacatcaaatgcaccagcaggagctggaccgcatcattgaaaagcaggctaaatactatccgtggctcgccacggagaaccccgctactggtgaaagagataggcatcaagccaagtacgagctggaccagcttgtcagctttcggatcccttattacgttggcccactggtgacccccgaagtacagaaagcaacatctggggccaagttcgcttgggcgaaacgaaaggaggatggagagataactccttggaatttgtgggacaagattgatcgcgcagaatccgccgaggcttttatcaaaagaatgaccgtgaaggacacatacctcctgaacgaagacgtcttaccagccaattcactgctatatcagaaatacaacgtgctcaatgagctgaacaatgttagggtgaacggccggcgccttagcgtcggtatcaagcaagatatttataccgaattgttcaaaaagaaaaagacggtgaaggtaagtgacgttgcatctctggtgatggccaaaactagaggggtcaataagccctccgtggagggactcagcgatccgaaaaagtttaactcgaatctggctacataccttgacctgaaatctatcgtcggcgataaggtggacgataacaggtatcagaccgacttggagaacattatagaatggcgttccgttttcgaggatggcgaaatctttgccgacaagctcactgaggtggaatggctgacagatcagcagcggtcagcattagtcaaaaagcgatacaaagggtggggaagactgagtaagaaactactcaccggtattgtagacgagaatggccaaaggatcatcgatctgatgtggaacacggaccagaatttcatgcagattgtgaaccagcctgtttttaaggagcaaatagaccagcttaatcagaaggcgatcaccaacgatgggatgacattgcgcgaatgggtggagagcgtcctggacggagcttatacttctccccaaaataaaaaggccatttggcaagtggtacgggtggttgaagatatcgtcaaagcagtgggcaacgccccaaagtccattagcatcgagttcgctagaaatgagggtaacaaaggggaaataaccaggtcacgccgaacacagctccagaagctgtttgaggaccaggcccacgaattagtgaaggataccagtctgactgaggaacttgagaaagcacctgacttgtccgatcggtactacctctatttcacacagggcggaaaggacatgtacaccggcgatcccatcaattttgacgagattagcactaaatatgatatcgaccacattctgccacagtctttcgtcaaggatgactcactagacaaccgtgttctggtgagtagagctgaaaataacaaaaagagcgatagggtgcccgccaaactctacgcggccaagatgaagccttattggaatcagctgcttaaacaagggttgatcacgcagcgcaagttcgagaacctgacaatggacgtagatcagaacataaaataccggtccttaggatttgtcaagagacagctcgtggaaaccaggcaagttattaaactgactgctaatatccttggttctatgtatcaggaggcaggcaccgacattatcgaaacacgagccgggctgaccaagcagttgcgcgaggagttcgatctcccaaaggtgcgggaagtcaacgactaccatcacgctgtggatgcctacctgactacatttgcaggacaatatctaaatagaaggtacccgaaactgcgttcgttctttgtttatggcgagtacatgaagttcaaacatggtagcgacctcaagctgcgcaactttaatttctttcacgaacttatggagggggataaatcccagggcaaggtggtagaccagcagacgggagaattgataaccactcgggatgaggtcgcgaagtcattcgacagactgttaaacatgaaatatatgctcgtgagtaaggaggtgcatgacaggtctgatcaactgtacggcgccacaatcgtcaccgctaaagaaagcgggaaacttacatcccccattgagatcaaaaagaagcgacctgttgacctgtatggagcctacactaatggtacctcagcatttatgacgattatcaaattcaccggcaacaagccaaaatacaaggtgataggggtacccacaactagcgctgtgggactaaaacgggtcggcaagcctggttctgaatcctataatcaggagctccaccgcattatcaagagtaacccaaaagtgaagaaagattttgagatcgttgtgccccacgtcagctactctcagctgattgtggacgatgactgcaagttcaccttggcctccgatacatatcagcatccggcaactcaactggttttatcaaaagaaagtatggagatcattgccgacgatttcaagtttgtgaaagaaaataccgctacggcggacgagcagctcgtcagagtattcgatgaaatagtgaaccagatgaatcactactttacaatcttcgaccagaggagcaaccggcaaaaggttaccaaggcccgagataaatttgtgtcgctgcctactgagtccgagtatgaaggggcaaagaaaacacaggtcggcaagaccgaggtgattactaatcttctgatgggattgcatgctaactctgcccagggcgacctcaaagtactggggctaagcaccttcggatttttccagtcaagtggcggtctgaacctttccgaagacgccatgatcgtgtaccaatctccaacagggctctttgagagacgcatttgtctgaaggatatctga

SEQ ID NO: 2925 - RNA, 3942 nt, synthetic construct
  misc_feature 1..3942: note = Cas9 variant
  source 1..3942: mol_type = other RNA
atgagcttcaaggagaactccaaaatctactatggcctggacattgggaccgattctgtgggatggtcaacaactaatgaaaagtacgagctccttagatataaaaacaatctgatgtggggtgtcagtttgtttgaagccgctagcttagcagaggaaaggcggggccaccgcacgcagcgacgtagatacgacaggcggcaacagcgcgttgccctgctaggggaactcttcgcgaaggagatactgaaaaccgatcccgactttttccttagactgaaggaatcctctttgtatcctgaggataggacatcgaagaacgtgaatacttactttgacgatgctgacttcaaagattcagactattttaagatgtacccaaccgtacatcacctcatcaaagaactgagcgagagtaacaagccgcatgatgtgcggctggtctacctcgcctgcgcattcattgtggcccaccgcggacactttttaaatggcgctgacgagaacaatgttcaggcagtgctggatttcgactcctcttattgtgaatttacagactggttcaaaagcaacgatatcgaggacaatcccttttccgaatcagtcaagaacgagttcagtgtgattcttcgaaagaaaatcggtataaccgccaaggaaagagagatcaaaaatttgctgttcgggactacaaagacccctgattgctacaaagacgaggaatatccaattgatatcgacgtactaattaagtttatcagcggaggcaaaacgaacctcgctaagctgttcaggaatccctcttacgatgagcttgacatacagactgttgaagtgggcaaggccgattttgcggacaccattgatctgttggcatcctcaatggaggacacagacgtccctctcctgagcgccgtgaaagctatgtatgattggagtttactgatcgacgtgctcaaggggcagaaaactatttctgatgccaaggtctgtgaatacgagcagcataaatccgaccttaaggcactgaagtatatcgttcggaaatacttggatcgtgctcagtacgacgagatcttccgcaccgccggagaaaagccaaactatgtgagctactcgtataacgtaacagatgtgaaactaaagcagctgccctctaattttaaaaagaagaactccgaggagttctgcaaatacattaagtcaaaactcgagaagataaaacctgaaagtgacgatgaggcggtctataatgagctgatcgaaaagtgtaacagcaagaccctttgcccaaaacaagtgacggacgagaatagagttattccgtaccagctgtattaccacgaattgtccatgatcctcgataaggcctctgcatacctggactttttaaacaaaactgaggatggtataagcgtgaagcagaaaattctgacactaatgaagttcaggatcccctattttgtcggccctctcgtgaaacggaatgagaccgacaacgtatggatcgttcgaaaggctgaagggcgcatttacccatggaatttcgagaacatggtggactttgataagtcagaagacggattcatcagaaggatgacttgtaaatgcacatatctggccggcgaggatgtccttcccaagtacagtttgctgtattccaaatacaccgtgctcaatgaaattaacaatataaaggtcaacggtgagaaaatcagccctgagctgaagcaggacatttttaatgaacttttcatgaagacgtctcgggtgaccgttaaaaagatcacagagctgttgaaacgcaagggggctttctcagaagagaaaggagatagtctcagcggcgtggacatcaacattaagtcctctctgaagtcgtatttagattttagaaggctgctagaaaacggcagcctctccgagaatgacgtagagcgtataatcgaacggattactgtcaccacagataaaccacgactggtgtcatggcttaaggccgagtacagtgacttgcccgcagaagatatcagatacatttctaggctgagctataaagactacgggcgcctctccgccaagctgttaactggatgttatgagctggataccaacacaggtgaaatcggcgggcggtcaataatcgacttcatgtgggctgagaatattaaccttatgcaaatcttgagcgactcttacggatataaatcctttattgaggaagagaataagaagtactatatgatcaacccgaccggcagtatagcgcagactctcagagaaatgtacgttagcccttctgtgtccagggcaattatccgcacgatggagattgtcaaagagctgcgaaagatcaccaaaaaggatcccgacaaaatattcgtggaaatggcccggggtgggaagccagaggaaaaaggcaagcgtacatcaagtagaagggagcagatcgaaaagctatacgatagcgctaaagcctttgtatcggacgaggatatttcccatatgcgctctcaactgggaagcctctcagacgagcagctgcggagagaaaagtattacctttatttcatccagtttggcaaatgcatgtacagtggggaggcaattgatttctccaggttgggagacaatcactgttatgatatcgaccatatatttcctcagtctaagattaacgatgacagcctgcacaataaagtgttagttaagtcccaactcaacggtgaaaagtcagacgattaccccatcaaagccgagatccgaaataagatgcacccactgtggaaaaaccttttctatcgcgaccccaagaatcctgctgataaagtcaagtacgaacggctgactagaagcaccccatttacagaggacgagttggccggcttcattgaaaggcagctcgtggagacccgtcagagtactaaggcagtggcgacactgctaaaagaaatgtttccggattctaagatcgtctacgttaaagctgggcaagtgtccgagttccgccatgacttcgatatgctgaagtgccgggaaattaacgacctccaccatgccaaagatgcatatctgaatatagtgatcggaaacgtacacgacgtcaagtttacgagcaaccccatgaatttcgtgaagaacgccgataaacattacaccattaaggttaaagagactcttaagcacaaagtgtcgagaaatggcgagacagcttggaaccctgaaaccgactttgatacagtcaagaggatgatgtcaaagaactctgtgcgatatgttcggtactgctataaacgcaagggtgggttctttaatcaaaatccagacagagccggcaaccccgacttggcaaggctgaaaaaggatttagaccctgtgaaatacggaggctataatagtaagtccatcagctgtttctctctcattaaatgcactggggtaggagctgtcatcataccagtggagctgctttgtgaaaagcggtactttagcgatgactccttcgcctcagagtacgcgtatagtgtgctgaagaacgccctacccgctaaaaatatcgcaaagattagcatcgatgacatttcttttccgctcaaacgaagacctatcaagataaacaccctgttcgagtttgatggttaccgcgtcaatattaggtccaaagactcatatcactacttcacgatcagtagcgccatggctgccatctattccaaggatacctctgactacattaaggcagtttcgagctatatagataaatcagacaagggctccaaattcaagccaggggaagcgtttgatgtgttgagtaacctgaaagtatacgacgagatcgccaagaagtgcatttctgaacccttcagcaaaatctccaagttagctgaggccggaaaacgttggaagaaagaagagatttcactccagaattgtctgctttga

SEQ ID NO: 2926 - RNA, 3945 nt, synthetic construct
  misc_feature 1..3945: note = Cas9 variant
  source 1..3945: mol_type = other RNA
atgctgaagaaagactacagcatcggcctcgatattgggaccaactccgtgggacacgccgtcgttacagacgattataaggtgcccactaaaaagatgaaagtattcggtgacacgtctaagaagaccataaagaagaatatgcttggcgtgctgttgtttaacgaggggcagacagctgcagatactagattaaaaaggggagcccggcgccgatacacccgtagaaagaataggctgcggtatctacaagaaatcttcgcgcctgctctcgccaaagtcgacccaaactttttctaccgcctggaggaatcaagtcttgtggcagaggataagaagtatgacgtttacccgatttttggcaaaagagaagaggagctgttgtatcatgatacacacaagaccatctaccatctcaggagcgaactggccaataacgaccggcccgctgatctgcgcctcgtgtacttagcactggcccacattatcaaatatcgaggtaatttccttttggagggggaaatagacctgagaactacagatatcaacaaggtctttgctgagttctccgagaccctaaatgaaaactctgacgagaatctcggaaaactggacgtggccgatatttttaaggacaacacgttctcgaaaactaagaagtcagaggaacttctgaaattgagcggcgcgaagaaaaatcagctcgcacatcagctgtttaagatgatggtaggcaacatggggagtttcaaaaaggttttaggaaccgatgaggaacacaagctgtcctttggtaaagacacatacgaggatgacctcaatgatcttctggccgaagctggcgaccagtatttggatatcttcgtggccgcaaagaaagtctacgacgctgccattctagcgtctatcctggatgtgaaggacactcaaaccaaaacagtgttcagccaggccatgatagagaggtatgaggaacaccagaaggacctcattgaactgaagcgggtctttaaaaagtaccttcctgagaaatgccatgatttcttttccgagccaaagatctcagggtatgcaggatacattgacggcaaagttagtgaagaggatttctacaagtataccaagaaaacgctgaagggtatccccgaaactgaggaaatcttgcagaaaattgacgctaacaactacctccgtaagcaacgcacatttgataatggggccatacctcaccaggtgcatctgaaagagttagtagctatcgtggagaaccagggaaagtattacccattcctgagagaaaataaagacaagtttgagaagattctaaacttcaggatcccctattacgtcggccctctcgcccggggcaatagcaaatttgcatggctgacccgagccggggaaggaaagataactccatataacttcgatgagatgattgacaaagagacatctgctgaagattttatcaagcgcatgaccatcaatgacctttacttgccgacggagcccgtgctgcctaaacactccctcctgtacgaaagatataccattttcaacgagcttgcgggtgttaggtacgtgacagaaaatggcgaggcaaagtattttgatgcccagactaagcggtcaatcttcgagctgttcaaattggaccgcaaggtcagcgagaaaatggtgattaagcacctcaaagtagttatgccagctataagaatccaagccctgaaggggttagataacggaaagtttaatgcaagttacggcacctataaagacctggtggacatgggtgtcgcccccgaactactcaacgatgaagtcaattctgagaagtgggaagacattatcaaaacactgactatcttcgaggggaggaaacttattaaacgtcggttggagaactaccgagattttctgggcgaagacatactcagaaagctgtccaggaagaaatataccggatggggccgcttaagcgctaagctgcttgatgggatctacgacaaaaagacacataaaaccattttggattgtctcatgactgaggactactcgcagaatttcatgcagctgatcaacgatgacacgtattcttttaaggaaacaattaaaaacgcccaagtgatcgagaaggaagagaccctagcaaagactgtgcaggagctgcctggatccccagcgatcaaaaagggtatactccagtcactggaaattgttgatgagatcattaaagtgatgggctacaagcccaaaagtatcgtagtcgaaatggctcgggagacccagaagacacacgggaccagaaagagggaggaccgcgtgcaacagatagttaaaaatcttaaggatgccaacgaattgccgaaaaagctgcctagcaatgcagagttatccgacgaacgaaaatatctctactgcctgcagaacggacgggacatgtatactggcgcccccttggattacgaccatctgcagttctatgatgtggaccacattatcccacaatcttttcttaaggatgacagcattgagaataaggtcctcacaatcaaaaaggaaaacgtgcgtaaaacgaatggtctgccttcagaggctgtaatacagaagatggggagtttctggaaaaagctactggatgccggcgcaatgaccaacaagaaatacgacaatctcagaaggaacctgcatggaggccttaatgagaagttgaaagaacgctttatcgagcggcagctggtggaaactagacagattacaaagtacgttgctcaattactcgatcagaggctgaactatgacgggaatggagtcgagcttgatgagaaaatcgccattgtgaccctgaaggcgcagctagcctcccagttccgaagcgaatttaagctccgcaaagtgcgggctctgaacaatttgcaccacgcacatgacgcctacctgaacgctgtcgttgccaacttaatcatggcaaagtatcccgagctcgaaccagagttcgtgtacggtaaatatagaaagacaaaatttaagggcctggggaaagcgactgccaagaataccctttacgctaacgtgctgtatttcttgaaggaaaatgaggtataccccttctgggacaaagccagggatctccctacgataaagcgttacctgtatcgcgcacaagtcaacaaagtgcggaaggctgaaagacagaccggaggcttttctgacgagatgctagttccaaaatcagatagtggtaagctgcttccgaggaaggaggggctcgaccccgtgaaatacggcggatatgccaaggcagtcgaaagctacgccgtgctgattacagctgatgaggttaaaaagggcaaaactaagaaggtgaaaaccttggtaaatatccctatcattgactccaagaaatatgaagcggatccaacagcctacctggcatctcgagggtatactaacgtcaccaattcgttcatcttacccaagtacagcctcctggaggaccctgagggacggcgcagataccttgcttcctttaaagagttccagaaggccaacgaactgattttgccacaacacctcgtggaactgctatattgggtgaatgccaaggatggcgagcagaaactggaagaccataaggctgagtttaaagagcttttcgataagataatggaatttgcagacaaatacgtcgttgcccccaagaactcagagaaaatcaggcggctctatgaagagaatcaggatgcgacgccgatggaactgggtaagaacttcgtggagttgttacgatacacagctgacggggccgcaagtgactttaagttctttggagagaatattcctagaaaacgctataactctgccggcagcctgctcaatggtaccctgatctaccagtccaagactggcctttatgaaacaaggattgatctggggaaattgtga

SEQ ID NO: 2927 - RNA, 3948 nt, synthetic construct
  misc_feature 1..3948: note = Cas9 variant
  source 1..3948: mol_type = other RNA
atgggctacagcgtggggctggacatcggaaccggttccgtcggctgggttgtgacaaacgaggatgggaagctcgccagagctaaaggaaagaatcttattggcgtaaggctgttcaaaactgcagaacccgccgcggaccggcgcacgaaccgaaccacacgtagaaggttgtctcggcgcaagtggagattaaggctgctagatgagctctttgctaatgaactgggtaaaatagactcaaacttccttactcggctgaagtatagttacgtgcaccctaaggatgacgccaatcgcgcaaactattacgggggatatttgtttccaacccaggaggaaactaaaaagttccatgccaaatacccgaccatctatcacctccgactggctctgatgactgagagcagacaatttgatctcagggagatttacttagcaatgcatcagatcgtcaagtaccggggccacttcctaaattcccagtctaaaatgacaattggcaacacctataatccccaggaccttcaaacggccatggaaaactacgctgaggccaaggggttgtcgatcgaactgaagcagcctgaggagatggtggcgatactaactggagaagcaggttttggcctcagcaaaaaggccaaagctgagaagctgcttaataacttctttttcgataccaaagaagagaaggccacagttcaggcaatcctggctgggattgtgggaaatactatcgactttaccaaagtcttcaaccgtcagttgacaggcgataccctcaaggcctggaagctgaaattagacagcgaaacgtttgatgtggacagtgagccaattctgtccgacctcgatgacgatgagactgaacttttcttcgcgatccgccaagcctttgacggtttcacactgatgaatttgctaggggatcagacctctataagcgcagctatggtagagagatatactcagcatcacgacgatctgctcacagttaaacaggtggccaaaaagcaaggactgtcccacaaagaattttcaaacatttacagtgctttccttaaggacgataccgacaagggcatgaaaaagctgttggaggaaagcaacctctctacggaggatgtcaatggcatccagctgaggatggactcccatgactttttaccccagcaacggaccaaagccaactcagtgattcctcaccagctgcatctagcagagctcgaagccatcatcgagaatcaggggcagtattacccattcctgcttgaaacatttgagaaggaaggaactgctgcgaacaaaattgcagagttgctgaagttccgaataccctattacgtgggtcctatggtcaccaagaaagatgttgagaatgccggcggggacgctacaaaccactgggtgactcgcaatgaaggatacgaaaagagcgccgtaaccgcatggaactttgatcaagtgttcaatagagaccaggccgctctcgattttatccagaggctgacaggcaccgacacttatcttattggtgaaccaacgctgccgcagaacagtttgaaataccaaatgttcacagtcctcaatgagctgaacaatgtgaaggttaacgggcggcgcatcgataatcagaccaaacacgacttaatacaggatctgtttaagtctaagaaaactgtgtccctaaaggccttccaggactattaccaaagccagggcaaatcggatattcaggtcgtgggactcgcagacaagaccaaattcaactctaacctgtccacatatatcgatctttcaaagacctttagtgcggaggaaatggagaatccccagaaccaagacttgctggaacagatcgtagagattcagactgttttcgaagacagcaaaatcgctgagagagagctctccaagctggaattaacacctgagcaagtgacgaagctggccaaaacccattacactggctgggggaatctttctaacaagttgctcacaaccccaattgtcgatgtgagcggaaagaaggtctcaatactggaccagctagcaaaaacaagtaagaattttatgtccatcattagcaacgaacagtatggtgtgcaggattggatcaaggagcaaaatactaccgaaacgaccggcacactggaggacaaactcgccgatctgactacctctcccgctaacaagagggggatcaaacaggccttcaatgttctttttgacattcagaaggcaatgaaatcagagcctgatcgtgtgtacttggagttcgctcgggagacacagacaagtgtacgaaccatgagcagatacaactatctgaagggattataccaatccaagtctctcgacgccgaagcgaaaaatctgaagaaagagcttgccgaaacggatcagaagaaatttgacaacgataggctgtatttgtacttccagcagcaaggcaaggacatgtatacaggtcagccaataaatatcgataagctctcgagcgactacgacattgatcacatcattccccaggcttttaccaaagacgattccatcgacaaccgcgtcctggtgtcacggccggagaatgcaagaaagagtgattctgggacttatacaaccgaggttcaagccgctgccagcggcctatggaaaactctggtgcagtccggattcatatcaaggaagaaatacgaccgcctcacccatgcaggcgattacagcgaagggcagaagacaggatttatcgcgcgacagctggtcgagacgcggcaaattatcaaaaacgtggccgctcttattgaatctgagttcgaccagacccaggccgtagcaatccgtgctgagataactggtgatatgagaaggttggtggccattaagaagcaccgcgaaatcaactcctttcatcacgcattcgacgccctgttaattacagctgcgggccagtatatgcaaaaacggtaccctgatagagacagtaataacgtttataatgagttcgacaggtacaccaacgattatctcaagaaactgcgagaatcatcttccaaggacgaggtccgcaaacttaagccctttgggttcatcgtgggaacaatggccaagggcaatgaagattggactaccgagcagacggagtacctgcggcacataatgaactttaaaaatatcctaacaacctataagactggtccagacagagggcctctctcaaaagaaaccatttacgcagtggatcccaaggctaaactgatcggcacaaacaagcataggcaggacgtcagtttgtacggaggctatacttacccatatagcgcctacatgaccctggttcgtgccaatgggaagaaccagttagtgaaagtgtcgcgctccgctgcatctctcatgaaaagcggacaactgaaacttgaggattatgtacagcagcagcccgaagtcaagaaattcgagaagattctgttggaacacctccctctgggccaactggtggacaatgatggtaagctgatgtaccttacatcatatgagttttaccataacgccaaacagctctggctgagtacggagaatgcggacttgatctcctctctgagcatagattccgacgatcagaagttaattaaggctttcgacatcctcaccgccgactcagttatcgaacggtttccattctacgagattgatctgaagaaacttatcgaactgagagacaagtttgtgttgattgataacaagctcgacgtcctgagggtggttctaaaagcactgcaacttgatagcgcccagcagaagccgctcaaactgatagacaaggctgcaactgattggaaaaattatcgacaggccgggggaatcaagttgagtgacaacgcggagattatctaccaatctacaaccggcattttcgaaaaacggatcaagatatccgatttactgtga

SEQ ID NO: 2928 - RNA, 3951 nt, synthetic construct
  misc_feature 1..3951: note = Cas9 variant
  source 1..3951: mol_type = other RNA
atgctgcagaagaactacaccatcggcctcgacattgggacaaatagcgtgggatatgccgtcataaacgataattacaaagttcccgctaagaaaatgaaggtgcttggtaacactgacaaaaagacgatcaagaaaaatctgatgggcgtattgttattcgatgcaggggagaccgccgcgacaactagactgaagaggggaacccggcgccgatatacacgtagaaggaaccggctacgctacctccaagaaattctgggccctgagcttgctaaagtggacgccaattttctgcacagattggcagaatcctctctcgtcaccgaggataaggaattttcagcctatccaatctttggtgacagggaggaggaactgctgtaccataaaacttataagacaatttaccacctccggagtgctttagcaaacaaggatgagaaagccgacctgcgccttatctacttggctctggcccatataatcaagtatcgagggaatttcctaattgaaggagagatcgagctcagcgataccgacattgataaagtgtacgcggacttttgcagatccttcaacgaactgtttgatacggaggttcttcaggaaatcgaggtggaagcaatattcaaggacaaaactctgtctaagaccaaaaaggccgaggagttggtcaaggtgtcgggcgtaaagaagaatcaggttgctcaccagtttctcaaaatgatggtgggcaacacagtcaatttcaagaaagtgtttaacctgactgaagaccaaaagttatcattcgggaccgatagctatgaggacgaactgaatgatctccttgccaagagtgacgataggtacctggacgtgtttgtcgcagctaaaaaggtttatgatacagccattttggcgaacatcctaaacaccaaaaattccgtggccacgaagactattttctctcagagcatgatcgagcggttcaaagaccatcagaaggatctgaaggaactcaaacagctgtttaagacataccttccggagaaatatcccgacttctttggaaactccaaggaggatggttacgcaggctacatcgaagggaaaaccaatgaggaaaagttctatactcacacaaagaaaattctgaagaacatacctcaagctgcctcagtattggctcagatcgacgtgggaaattacctccgtaaacagcgcacctttgacaacggcgtcattccacaccagatccaactgaaggagttactggccataattgaaaatcagggtaaatattaccccttcctactcgagaacaaggagaaaatcgcaaagatcctgacgtttaggattccttattacgtggggccacttgccagaggaaatagtcggttcgcttggttgaagcgagttggcaaagaaaagatcaccccctttaacttcgagaatgtggtcgatctggaaagctctgcggagcgctttattgagagaatgacactcaacgacctgtatcttcctgaagagaaagtgctgccaaagcattccatgttgtacgaaaaattctcaatatttaatgagctcgcaggcatcaggtacattactgataacggggaaatgaagttcctggacgcccagaccaagcaaagcatcttcgagttatttaaacaggagcggacagtaaaggaaaagaaggttctggatctactcaaaactctgatgccgagtgagcgcgtggtcgctatcaagggaattgacaatggtaagttcaacgcctcttttggcacctatcacgatctttccaaaatggggttcaagacagagaaaatagcaagcgaatcgaaccaggccagatgggaagagatcattaagaccttgactatctttgaggacaggaaactgattaagtctcgtctccggaagtacgatgacttcctgaatgaaaaagagatcggagctttatccaagcgaaaatatacgggctggggtagactgtcagccaaacttatagatgggatctacgacaaaaagacacatcagaccattttggattttctcatgaacgaagactataatcaaaacttcatgcagctgatcagtaatgacaactacagctttaaaaagattatcgaggattcccaggtgataaaggaagagggctctctaactgaggtcattcaggaactgcccggaagccctgcaatcaaaaagggcattctccaatcaatcgagatagtggacgaactggttaaagtgatgggagggaatccaaagaaaatcgtagtcgagatggcgagggagacccagaagacacacggtaccactcgccgggaagctagaattaaggagatcattaaaaaccttaataagttgaaactgaacgaattacccaaggatctccctagtaatgaggaactgtccgacgagaaagtgtatctttactgtctgcagaacggcagggatatgtacacaggggccccattggacctcgataatctgagccagtatgaggttgaccacatcataccccaatctttcctaaaggatgactcaattgaaaacaaggtgctgacggcaaaaatcgagaatagtcgcaagaccaacggactcccgagcgtcgaaatcgccaaaaagatgggcgctttttggcgatccctgcttaaagtgggtgccatttctgagaagaagtaccggaacttgcgtagatcgctgcatgggggcatgactgaaaaattaaaggagacattcgtaaaaaggcagctcgtggagacccgccagatcacaaagtatgttgcacagattctgaatagccggtttaacgaagagaaaaatgaagataaggtcgctatagtgactcttaaggcccaactgacctcccagttcagaaaagacttcgagctatacaaggtgagggaaatcaacaatctccaccatgcgcacgatgcctatctgaacgctgtcttggcaacgctgttaatgacctcatttcctgagctcgagcccgagttcgtttacggaaaatatcgaaagacaaaatttaagggcctggggaaagccactgctaagaataacctttacaccaatattctgcagttgctcaaggaagaaagtgcccaatactgggacacaaaagagcgcgacctggcaactatcaagaaaaacgtgtatcaggcccaggtgaataaggtacggaaagtcgagagacagaccggatctttctacgatgaaacggtggcgaaaaagagcgcttcccaaaaactatttccaaggaagaacggtctggaccctgttaaatatggcgggtaccagcgtgccaatgagggatattcacttctcttccgcgcagatatgctgaacaagcggggcaaaacaaagagcgtgaagaccttggtcaaaattcccatcatagaatctgctcagtacctggccgacccaactgagtatttagcaaagagaggttactacaatgtgtccgaacatagtctcctgcttcccaaatttagcctgttggagaacaacaatgggctcaggcgatatctggcctcttccaacgagttccagaaggctaatgaactaatcctgcctaaacaccttgttcggctcctgtactggtcacaaagtaagcagcgcaaggaggaattgaacaaacacagagcggagtttgccgaattattcacatatattatggattttgcagacaagtacgtggtagctccgaaaaatagcgagaagatcaaaaacatttatgagaataacaaggattcgtccgtcgaagtgctgggcaaaaatttcatcgagctcctgaagtacaccgccgacggagccgcttctgatttcactttcttcgacaccaagataccaaggaaacggtataacagcgcaggcgatcttctggacgggacattgatttaccagtcaaagacgggactatacgaaacccgaatcgacctgggcgccatctga

SEQ ID NO: 2929 - RNA, 3957 nt, synthetic construct
  misc_feature 1..3957: note = Cas9 variant
  source 1..3957: mol_type = other RNA
atgatgatcaagctgaacaatatgaaaaagattctcggccttgacctggggaccaacagcataggatgggccgtggtcgagacagaagataataaaaagttcgagttgttagacaaaggtgttagaatctttcaggaaggcgtgaagattgagaaggggatcgaatcctctaaagctgcagagaggactggataccggtcagcccgccgaattaagttccgtagaaggctgcggaaaatcgagacgctaaaggtactcatagaaaacaatatgtgccccctgagtatggatgagcttatcgtgtggaaagaaaacaagaataactatcctaagaataaaatcttttacaactggctgaagaccaaagacccaaaggagggcacaaatggtacttatattaacccgtactatttccgcaccgaggcgattaaaagaaagttggaaaatacaaacgatgtcgggagggctctctaccacctggcccaacggcgcggatttaaaagcaatcgactggagtccaccgacgaaaagtctagaggcatcgtgaagactgagataaacaaactctcgtcagaattaaacggcaggtatctgggggagtacttctacgagctttatttgaagggagaaaagattcggaagcgtcatatcagccgcgaggaacactacctgaatgagtttaaaaagatttgtgaagttcagaacttcaataaggagctagcagagaaactcgaaagagccatcttttatcagaggcccctgaagagtcagaaaggtcttgtgggcaagtgcacactgcaaaacaataaacatcggtgtcctatctcccgaccagagttcgaagagtttcgcatgtggcagttcattaactctataaagtacaagaatagcgatgggaaatttgacttcttgaacaaggaacagagagagaatatcattcccgctttcgtctccaacaaaaatgcaacctttgagttctcaaagatcgagaaaatactcaacaagggagtgcacatttatcagtttaattacaagagtaaccatacgatcggcagcaatcaaactatgatcaacttcatggatgtatttgacattgataggaaactgaccaacgcctggttactgtgcgttaataagatctatgaactctacacagctaaaactaagaaagacggttctcttaagtccaaatcagaagtgattaccgatgtctggcacgtgctgttcacatttgacaacgaggagaatttgaaggagttcgcccggaacaagctactgctcgacgaaagcagtgcgcagaaattttctaagataaatctgaaacaggattactcccagcttagcctgaaggcaatcaacaaaattttgccttatctccaagaagggctgatctactcgtatgccgtgttcatcgctaatattgagaacgtcataggaaagtctatctggaatattaaggaaaaccagcagatcattcgcacctccatcaaaaagataatcgacaatcacaaaacggagttagatattaacactatcacaaattcactgattaacgactttaaggttaattacaacaacgcccataaagagtataaggtggatgacatcgatctaaagaatataagagagaaaattatcaagtactatggcaacaaaacctggaattgtctcccagaagacgaaaagctgtacgtaaaagagaaggtggaaaaactttacgagaaacaattgaagagtggcaaaagggggattttcatcgagaagatacgtctggatgaccggatcgaaaactttctcaaagataatttcgacagctccgagctgaaccttaagaaactgtatcacccctctgacgtcagcgtgtacaagtcagttaagattactgatttgggactccgactgttaggtagtcctatgatcccatccattaaaaatccgatggcaatgagagctatgcatcagctgaggaagctaatcaaccacctcataattgaaggcgtgatcgacgatagcacaatcattaatgtcgagatgtctcgcgaactgaacgacgccaatatgcggaaagcgatcgagagatatcagaggcagcgcgccaccgagaacgaagagttcaagacgaaaattaaggaactttacaagaaagagtgcgggaccgattttgagcccaataacgacgatataatgaagtatcgattgtgggaggaacaaaatcacaaatgtctgtacacaggaaagtcaatcggcatttgcgacttcatcggtagtaaccctgcatttgaaattgagcatactatcccacggagcctctcctatgataactctctggaaaataaaaccttatgtgagaaggagttcaaccaacaggtgaagaaaaatcgtataccctttgaactgtcgaactacaaggagatcattagcagaatcaataactgggaaattaaagctgaggaacttttcaagcagatccaaaaagtaaagatacagtccaggatggccgctacaaaggagattaaagacaatgccatccagcgcaagcacttgctccagatggagtttaactactggaatgggaaactgtcacggttcactagagaagatgttcctgagggctttaagaacagtcagctagtggacatcggaattataaccaaatatgcaagggcctacctgaagacagtcttcaataacgtgaataccgtcaagggctctactgtggctgaatttcgaaacatctgggggctccaggagtatttcgagaaaaaggatcgcagcaatcatattcaccattgcatcgacgcgattacgatcgcatgtctgacaaaagacaagtacgattttcttgcccacttgtatcacctggacgaacagaacaatcgggatgctgttcatagagccatgataaaatccaagccatgggagaacttcgtgcaggacgtaaaagaaatcgagaaccaaattttagtctcacactacacccccgataatctcccgaagcagagcaagaaaatcctgaggaagcgtggaaaaattcagaagaacgaaaatggtgaccttatctatgagaaaggcgatgcagtgcgcgggtctctgcataaggagtccttctacggagccataaagcgggaaattatcaacaaaaagggcgagactgaagagaaagttttgtacgtgaagagaaaacctctcgaatttagtgacctgggtttcaagaccatcagcgagctagagaatattgtcgatgacgctgtgagggataaggtactgaacgccgtgaaagacaaggggctcaaacaagcactgaatgaacccatctggatgaacgaggaaaagcagataccaattaaaaaggttcgatgctatacaccttctgtcaccaatcccatcaaccttaagaaacaccgggataagtccaaacacgagtacaagcagtcatatcatgtgactaatgacggcaactacttgatggtgatttatgaaggaaaagacagtcaggagaaggtcaaacgcgattacgagatcgttagcaatctgcaagcgggcgaatattttaagcagtcggtgcacggggtgttaaaggctcagggaataaacaatctcgagggtctgattccaaaattcaaggaatccggcaaaaacatccttcccctgaagtacatcctaaaaacagggacgatggtaatcttttgggagaactaccctgaagagatttgggacattgataagaatcagctctataagagactgttcaaagtcacccaatttgagtctgacggaaggatacaggcccggttccatcagatcgcaaagccagataacgaattgactaaagtgagcgagctggacttttcaaatattgccgaaaagatccgattaagtaaaggcaacctcaatatgctggttaacggttacgatttcaagatcaatgtgcttgggcacattgagaagctgtcctga

SEQ ID NO: 2930 - RNA, 3957 nt, synthetic construct
  misc_feature 1..3957: note = Cas9 variant
  source 1..3957: mol_type = other RNA
atgggcagcaacatgctgaagaaagactactccatcgggctcgatattggaaccaattctgtgggtcacgccgtcgttacagacgattataaggtgcccactaaaaagatgaaagtattcggcgacacgtcaaagaagaccataaagaagaacatgcttggggtgctgttgtttaatgagggacagacagctgcagatactagattaaaaaggggcacccggcgccgatacacacgtagaaagaacaggctgcggtatctacaagaaatcttcgcccctgagctcgcgaaagtcgacccaaattttctgtaccgccttgaagagagtagcctggtggctgaagataagaagtatgacgtttacccgattttcggtaaaagagaggaggaattgctctatcatgatacctacaagactatctaccacctgaggtccgccctggcaaacaatgaccagcccgccgatctccggttagtgtatctggctcttgcacatattatcaaataccgcgggaactttttgctggagggagaaatagacctacgaacaaccgatatcaataaggtcttcgccgagttttctgagacgctcaacgaaaattcggacgagaacctgggcaaacttgacgtggctgatattttcaagaataacactttttcaaaaaccaaaaagagcgaggaactgttgaaactcagtggcgccaagaaaaatcagctggcgcaccagttattcaagatgatggtagggaacatgggatcctttaaaaaggttctgggtacagacgaggaacataagctctctttcggcaaagatacttatgaggacgatcttaacgacctgttggcagaagccggggatcaatacctagacatctttgtggctgccaagaaagtctatgatgcagctattctggccagcatcctcgacgtgaaggatacccagacaaaaaccgtgttctcccaggcgatgatagagagatacgaggaacaccagaaggacctgattgaacttaagagggtcttcaaaaagtatctgcctgagaaatgccacgactttttctcagagccaaagatcagtggatacgccggctacattgatggtaaagttagcgaagaggacttttataagtacacgaagaaaactttgaaggggatccccgaaacagaggaaatcctccaaaagattgatgcaaataactatctgcggaagcagcgtaccttcgacaatggagctatacctcatcaggtgcacttaaaagagctggtagccatcgtggagaaccagggcaagtactatccatttctacgcgaaaataaagataagttcgagaagattctcaactttagaatcccctactatgtcggccctctggctaggggaaattctaaattcgcctggcttactcgggcaggggaaggtaagataacaccatacaactttgacgagatgattgataaagagacctccgccgaagacttcatcaagcatatgacgatcaatgatttgtacctgccgaccgagcccgtgctccctaaacactcactgctttatgaacgatacacaatttttaacgagctggctggcgttcgctatgtgactgaaaatggggaggcgaagtacttcgacgcacaaaccaagagaagcatctttgagttgttcaaactcgataggaaggtcagtgaaaagatggtgattaagcacctgaaagtagttatgccagccatacggatccaggctttaaagggactggacaacggcaagttcaatgcctcttatggtacatacaaagatctagtggacatgggggtcgcacccgagctcctgaacgacgaagtcaattccgagaagtgggaagatattatcaaaactcttaccatctttgagggccgcaagttgattaaaagaaggctggagaactatcgtgacttcctcggagaagatatactgcggaagttaagccgaaagaaatacacaggctgggggagactgtcggccaaacttttggacggaatctacgataaaaagacccataaaactattctcgactgtctgatgacggaggattattctcagaactttatgcaactaatcaatgacgataactactccttcaaggaaacaattaaaaatgctcaggtgatcgagaaggaagagaccctggccaagactgtgcaggagctccctggttcaccagcaataaagaagggcatcctgcagagtcttgaaattgttgacgagatcattaaagtgatggggtataagcccaaaagcatcgtagtcgaaatggcgagggagacccaaaagacacacggaacccgcaagcgggaggatagagtgcagcagatagttgaaaacttgaaagacgctaatgagctgccggaaaagttaccttccaacgccgagctctctgatgaaaggaaatacctgtattgccttcagaatggccgcgacatgtacactggtgcacccctggactatgatcatttgcaattttacgacgtggatcacattatcccacagagcttcctcaaggacgattcaattgagaacaaagtcctgacaatcaagaaggagaatgtgcgaaaaacgaacgggctacctagtgaagccgtaatacagaagatgggctccttttggaaaaagctgctcgacgctggagccatgaccaataaaaagtacgataacctgcggcgtaatcttcatggcgggttgaacgagaagctgaaagaaagattcatcgagaggcagttagtggaaactcgccaaattacaaagtatgttgcacagctcctggaccagcggcttaattacgatggaaacggtgtcgagctggacgagaaaatcgctattgtgaccctaaaggcccagctcgcgagccaatttagatctgagttcaaactgaggaaggtgcgagccttgaacaatctgcaccacgctcatgatgcatatttaaacgccatcgtcgctaatctcataatggccaagtaccccgaactggaaccagagtttgtttatggcaaataccgcaaggcaaaattcaaggggcttggaaaagcgacagccaagaacactctgtatgctaatgtgttgtactttctcaaagaaaacgaggtgtaccccttctgggacaaggcccgggacctgcctaccattaagagatatctatacagggcacaggtaaataaagtccgtaaggctgagcgccagatcggcggtttctcagatgaaatgctggtgccaaaaagtgacagcgggaaacttctcccgcggaaagagggcctggatcccgttaagtatggaggctacgccaaggcagtggaatcctatgccgtcttgatcacggctgacgaggtgaaaaaggggaaaaccaagaaagttaagacactggtgaacattcctatcattgattctaagaaatacgaggcggacccaactgcctatttagcatcgagaggatacaccaatgtaacaaacagctttatactccccaagtactccctgcttgaagatcctgagggcaggcgacggtatctggcttcattcaaagaatttcaaaaggccaatgagttgatcctcccacagcacctggtcgaactactgtactgggtgaacgccaaagacggtgagcagaaacttgaggatcataaggctgagttcaaagaactctttgacaagattatggaatttgcagataaatatgtggtcgcccccaagaatagtgagaaaatccgcagactgtacgaagagaaccaggacgcgactccgatggagttggggaagaatttcgttgaattactgaggtataccgctgatggagccgcatctgacttcaaatttttcggcgagaacattcctcggaagcgatacaacagcgccggttccctcctgaatggcacgcttatctatcaatcaaagacagggctgtacgaaaccagaatagacttgggaaaactatga

SEQ ID NO: 2931 - RNA, 3960 nt, synthetic construct
  misc_feature 1..3960: note = Cas9 variant
  source 1..3960: mol_type = other RNA
atgttcagccagagaaacaatccctactgcgagctgctctttaagatcattgtgaccaacatagaagagaaaaatcttgaagtcatcatgggcattaggaactccgacatcttctttatttctaatttcatgtggtatcaaaagctgatcatgatgataaagaacatcttggggttagatctgggaacaaattcaattggttgggccctaatcgaggttgacgaaaacaatattcctatccggataattgctatgggcagtcgcatcattccactcagcacttccgataaggaggagtttcagcgagggctgtctatcacgaaaaaccagaatcgtaccgtgtcgagaacacagaggaagggatacgaccggaagcaacttcgcagatcagatctgaaaaagatcttgaaaaagtataacattttcccgagcgaagaactcctgaaactgcccatgctcgacttatggaagctgaggagtgattccgcaaatcctaacgaagacatatctgccgagcagcttggccggatcttgtacatgctgaatcagaagcgcggttataaaagcgcgcgatccgaggctaactcagataagaaagacactgattacgtacaggccgtgaaggggagatatgcacaactaaaagacaggcggcagaccattggacagtacttttacgaggagctcagtacagccttcagcgataagaacaatcagcaatattttcgtgtcaaagaagaggtgtacccacgcgaggcttatatcgaagagttcgacaccataattaacgcacagaaggacaagcacggctttctgactgataaagttatccatcagcttagaaatgaaatcatttacttccaaaggaagctgaaatctcagaagggcttggtgtccatctgtgagctcgaagggtttgagaaaacagtctatgacaaggaaaagaacaaaaataaggtggtattcgttggacccaaagtggcccctaagacctcaccactgttccagttatgccggatttgggaggtcgtgaacacgataagcctgaaaatcaagaatcccgagggtagtaagtacaaatggggcgaaaaggtgcctaacctcaaacagaaggagattcttgctgattatctgtttaaaaatgaaaacttgtctttctccactctactggagatcctcgaactgaagaaggaggacgtctacgttaataaacaaatccttaaggggattaaaggaaacgaggcctacgcggcactgcacaatgtgttgggcgatcatgaactcctgaactttgacgtaagcataatcacctcggatcacacagccattttagtggacaagaaaactggtgagatcctggaggaacgagctgggctagagctcgatgcctctctggaacgcgagccactttatcagttctggcataccatttactccttgaaggacctggatgaatgtaaaaatgcactcatcaagagatttggactggacgaggacatagctgaaaaactttcacacatcgatttcaacaaacaggcctttggcagtaagagcaacaaatccatgaggaagattctgccgttcttgatggagggctataattactctgagagctgctcactcgcggggtataaccacagtaattccctgacaaaagacgaacgggagagccagatcaccttagaacgcctggagctactccccaagaacaatctgagacaacctattgtcgaaaagatccttaaccagatgataaatgtggttaacacgattttggagaaatacggaaagccatctgagatcagggtggaactggcccgtgagctcaaacagtcaaaggatgaacggaatgacactgatctgcagaacagtcgaaataaaaagttaaacgaggaaattggtaagagactggcagagcttggcttgcccgtcacaaaaaggtatatccaaaagtacaaatttatattccctagcctctccaagaatctgaaagacgctcatgtgaacaatcagtgtatctactgcggggagacctttaacctaactgaagccctgaacggagatgcttatgacgtagatcacattgttccaaaggccctcctgttcgacgattctcagacaaataaggtgcttgtccatcgcaaatgtaactcgaccaagacgaatcagaccgcatacgactatatcacagccaaaggcgaggaagaggtgcggatttacagcgagagagtcgatgactggtttaagaaaggtatcatatcctattcaaagatgcaaaggttgaaagtgagtcacaaggaatacctggagcgcaagaaattagggaaggaaactgagaccgacaaaaagctctgggaaaacttcattgatcgacagctgcgggacacacagtatatctctcgtaaaagcagagagatccttcaaaaggtttgcaataacgtgactaccacagagggcggagtaaccgctaagctgaggaatttgtggggctgggatgacattctcatgaacctgcagatgcccaaatacaaggaactagggcagactatcacgaaagagtggacatccgaacacggaaagcgcaaacatcagaaggaggaaattgagaattggaccaagcgggatgaccacagacatcacgcgatagatgcactggtcgtggcctgtactaaacaaggtttcatccagaggattaacaccctcaattcaagcgagacaaaggacctgatgatcaaagaagttgaggaagctaagattgagtttaacgagaaaaccactcttttggaaaagtacctgaagacacagaaaccgttcacgacccgagaggtgatgaaggaagccgataaaatcttaatatcttttaaggcaggcaaaaaggtcgccactatcacaaagttcaaagctaccgggaagaataaagagacaggagtgattgtacctcgcggcgccctccatgaacagtccgtgtatggtaagatcaaagttattgagaaggacaaacccctgaagtacctttttgagaacccagataagatcgtcaatagtcggataagagacctggtggaaactaggctaagcgagaacgaaaacaattctaaaaaggcactctccaccgtgaaaaagaaccctattttctttaatgaggagaaaaacgaaatcctggagaaggcgtcatgctataatgatgctacggtcttgaagtacaaactgcaaaacttaaaggccaatcaggttgacgacatcgtggatgaacgtgtgaaattcctcgtaaaggagcgcctgacccagtttgggagtaaagaaaaggaggcattcaaggacattctttggtttaaccaggaaaaacaaatacccatcattacagtccggctgttcgccagaccagatgctaataacttgcagatcattaagaaagacaagaatggcaaagatatcggatttgtgctcactggcaacaatcaccacatagccatctatgaggacaaggatagcaagctggttcagcattcgtgtgcattctggcacgctgtggagaggaaaaagtacaacattcccgccgtcatcaaaaattccgcggacgtgtggtctctactgcttgataaggaactccctgttctgttcttggacaaactgccagccgatgagttaaacctcaagtttagcatgcaacagaatgaaatgttcattctggggctttcacaggagggatttgacgaagctatcaaaaacaacgacaagagtctgttgtccaagcatctctatctggtgtggtctataagcaataacgattactacttccgacaccacctagagaccaaaaatacagagctgaagaacattccgactgcaaaagactccaagcggtattttcgcttcaaatcagtaggtgcccttgtcggcatcaatcccatcaaggtgagactcaaccatctgggggaaattaccaagatcggagagtga
